United States Patent 10,245,287 (COMPOSITIONS COMPRISING BACTERIAL STRAINS) - sequence listing, part 2

SEQ ID NO: 3 - DNA, 3127431 bp, Enterococcus gallinarum strain MRX518 (residues 1,563,717-3,127,431 of 3,127,431)
tttgtccgcacgataagaccattgccactctttatcgtaatccgtatccacacgtaaattgtaagttgccactttcatttcttcatatcctttttaacaatttttggatctgttgcatttcttttcgaatctgtttggcttcaccgccgccatgccctttgtttaaatacacagttaattgttttggggttgagattcgatgataactgacaaaaaaatcggtcattgggcagataggatcctggctccctactgaagcaaagacagggccagtgatttttgctgccagatttttcaaatcatagtaggccatttggtaatagatggtctccttgctatctggaaaggtatcgatatattcttgcatcacatgatagctcccagttctgctttcgatgcggtgagaaatattcgagtgactaggaacatctgcaaaagtcgcaaagattggcgtttcagccagcgcattgacaattaatgcaatcccgccgccttgtgacccgcctcttaaaatcactcgttcagaatcaatctccggcagctctgctgcgacctctagcaggcgaagactatctgcaatcatgcgtttcatataaaaatcttctttttttaaaattcctcgaccaaacggtgcctcatgttgcgtcgtttcataaggatgtgtatctttcgtacggccgccttgcccgcgattatcgatcaccaagcaggcacaatcaatcaatgcccagtgggcaaactgaaagggttcctgtaggtgattcatataacctaaataatcgatgacgattggaagttggctcttatttttcggaactaaaagatagccgtaaatcgtttcattgtataaactttggaaattgacctgatagacatcgattcctgtcagcaatgctggttgttgctttcgttcaaacgctaatggaatctgtttgatttcttgtttgacttgtcgccaaaaacggtcgatttcctcctgagatggttcatttctaattgatttcattgacgtcaccctcttttgcccacaccttatgaaagaacagtacttgcagataagcgaatcctgaaatacctaaacatacgaataagaaagaattgatcttattcagcaatagaaatacgaatactggaatcactagcaagataatcgcatttgcggtactgctcaacaccgcataggcagtttcgtgtgcggtttgtttgactgtggaagaaaacaaacaaaacagtaggacaaacaccgtcaagaataaaccagctaaactgctgagtatcactgccaacaccccaagataagtggtgattcccatcaatccataaatgatcgccgcggtgacagcaacataccccacgatgatcccttcaagtacgattccacgtttgatatttgctagaaaagctcgactataccgttgccaaactggaacatctttttcttggtaaagctgatcgatggtttgatacaaggcgatcaaggctggtcctgtcagtacaatcgtgaccgcaggaacaaggaacaaaaaacttaataggatcatatccgcggcaaaggaaaagacacgatagtaccatccttcataagagaaaatttgtttcatctccactcacctgctccctttctagtttcaatcctactgatttcttgttgttttcttactcatctcttgtttattatccttttgctaaagtagtaaaaagatccttttacatatacttttgttggtacttttctacatctgctcgtctacactgcgcttcgcctacagttgcttctaggctggcgccaagaagaacttgcatgccttgctttgcaagccaatcgcagtgtttcaaagcaaaaagaggaaaggtcgttgggtctcgctttcctcttttcatcctttctataactgattatttaagtttttcgcggttttctgccattttttcagatttgacttctttgattgcatcccaattgttggaatctaaaaaactttcaaaatcagacagtgttgaatcaaacgttttttcatcttttgaacgaatcaaggagatgactgtgctatttagttttgttttgatcgaattattggaacgagcttctgcagtcccagcatctggatctgtgttctcaataacaaagtgcggataaagttttccttcaccccattcttgcatttgggttaatgcgctctctgtttctactttcaatgcattgacacggtcattgttgaagtagttgaagcgactgataccatatttcttgttgtacccttcgttatctgttttctccatttcttttacttcaggtaagtaatcgattttgccttcgtcattgtattcataagtgacgccttcaacaccgaatttcgtcaagatttgtcctggttcatcgatcaagtaagtgaatagttgagtgacttttgctggatcgactgcatcttttgtgatgtagttgatcaaccagcctgagataccggtttgattcaatgttggtttccggcctgatgtgctggctggtccatcaatagcaatatagcgagtatcagaattcttcataaattcagtaaagttgccgccttgaccactagttcctgcaacaagcatcgttgcatatttcccttgttttactttttcatcataggtcggaccgtcatctgtaaagctgtcatcactgatgttgccttcacggtatactttgttgaatgttttcaaccaattgatatattcttcatctaagttgcggtcatagtaattaccagattcatcttctaatggaacacctaagaagtcttgtaatttatctaagaaaggacctgctgtgtcaccgacagtcgtgaagcccattggggttagatcaggatatttctctttgatttgatccattactttgacaaaattttctggtttagaaatgtctggtttgccaagtgcttcatagacatcttcacgaatgacgaagttatcatttaccggaatattgccgctttcataatcggctgctgtattcgaatagtttggatagccatatgttttgccatcgtctaatgcaaaccaattgaaggtatcttctgttacgacattcaataggtaaggatcatattttttcgctagatcattcaatgagtaagcccagctatctgctttagtggctgcttgactggttttgtccatcaatgtcacgatgtctggcatatcgccacttgaaataagtgcattcaacttcgagtcgtctccggaaataaattcgatatcgatatttaaatctttcttgatctgtgcggtggtaacatcttccccaaaaggtaatgccgtccagtctgagttgatgtaccaagtgattttagttggttcttttttggtatcaagtttccatgctggtgttttctcatcaagctcataacgatctttgatcgaaaaatctgagctgctagcgtcatccgagctgccgccacatgctgctaagctaagtaatgctgttgctgccaataaactgcctaatacttttttcatactgatccctctttctattcttttaccgcaccggccatcataccgccgatgaagtgtttttgaagtaatggatagataatcaaaattggtacagtcgtaataacgatagtagccaattgcaccccgcgggtcgttgcctgcacgacaaagtcggtactaccgctttcggtcatcgtgcttaagttggactgcacaatgatttcatagatcttcatttgcagcggatagagatattctttggtgatgtacaattttgtggtcataaagtcgttccattgtccgacaccattgaacaatatgatggtagctaatgctggtttcgttaatggtaggaaaatcttgtaaaaaatttgaaattcgctggccccatcgattttcgccgattcttccaaagaaggaggaatctcacggaaaaagttcatcaagataacgacgtcataatagctgaataacgctggaatgatatagacccaaaatgaatctagtaaccctaacgatttgatcagcaaataggttgggatcatccccccgccgaagtacatcgtaatgactcctagcgtggtgtagatattccggccgatcagccgtgatttactgagtccgtatgccacaacggcacaaaacagtgtatgtgtcactgccccgatcaatgttttcagtacagagatcaaaaatgcccgtgggatactgtcatcggaaaatactttccggtaattctcccaagtaaatccccgcggccataaaacgagaccgttttcagccaaccctgaactagaagataccgatgagactaagatattccagattggaataatgatcagcagcgaaaacagaacgaggatcactgtgttaaagaaataaaaccatttgttctcttgtgttcttctttttatcacttggtcacccctcctataagataactgaattgccattgttcaatttgcgtgtcacacgatcggtgatgactagaagaatgacagaaatgattgctattcccaagccaaccgctgttgcatatgagaaatcgccttgtgtcagacccattttataaacgaatgagttgatgacttccgatttgttttggttttgtgaattcatcaaaaccaatgtctggtctaaattagatcctaagatgccgctcacatttaggatcagattcaatgaaatgatcggcgtcaaaagtggtaatgtgattgtccgaatctgcgtcaacttggtggcgccatcgattctggccgcttcataaaaagttggatcgatacgagacattcctgcaagatataaaatcgttccccatcctacttctttccaaaggtcagataaaacagcgatccaccaatatttattaggatccaacaaatgattgacacctttatccatcattcctaaagacatcaggacttggttgataaacccattggtcgacaaccatgaaatcatcataccgcctaggacaatccaagaaaaaaagtgagggatatacgaaacggtttgaataaatttcttcaattttccgtcccgcatctcaaaaatcataatggcgagaataattggaatcgcaaagcctaagcctaacttcatcatactgattgctaacgtattcccaactgcttcccagaaaaaactgtcgtgtaaaataattcggaaattctctaaccctacccatggtgcagaggaaatcgtatcaatgaccgtataattcttaaaagcaataatgattccataaattggaatataattaaatacgatcatgaatgccacgcctggtagtaccatccaatgcagttgccgctgccggtatatctctttcagcttactcatacgcaaaaaccctttctgttatcgtctcaacgctcatcctatctttttctttttagtgaaacgtttctacgagttgattataaatcgcgctagaaagaaatgcaagcctttacatcattaaagttttatcatttttcattatctcatttttaatgacttacatatcctttaaagatatttttcacaaacaaaaacctttaataacaaggttatccgctacaccagatcacttatttttgtttttctacagctcttgcaactgtttattgcgttgtttcttttctcgaagcaactaattttagaacatgaacgatagaaaaacgtttcactaaaccataaaaaaaagagctttacagctcttcaaaatgattttcatagccaaaatgggtataagcaagtgtggtagcgatccgtccacgtggtgttcgtttcaaaaaccctctctgaatcaagtaaggctcatacatatcttccacggtctctgtttcttcaccgatgtttacagataatgtgctgaggcccacaggccctccaccatacaactcgatcatcgttcgaatcagcttctgatccacataatctaaaccagcatgatcgacttgcaaaagcagcaaagctttatctgcgatttggcggtcaatgattccattcgcttgcacttgcgcgaagtctcgaacacgtttcagcaagcggttagcgatccgtggcgttcctcgagatcgtcgagcaatctcaaatgccccttcttccacgatctccgtctgaaaaatatccgctgaacgtaagacgatttcttttaagtcttggtcttcataatattccatatgagaaatgatcccaaatcgatcccgtaatggtgcagaaagcatccctgccctagtcgtagctcctactagggtgaatggcggcaacgggaaatggaccggatgcgcagttgttccttggccaaccatgatgtccacgaagaaatcttccattgcagaatagagcatttcttcggcaactcgcggcaaacgatggatctcatcaataaacaagacatcccccggctgcaattcattcaaaatcgcaatcaagtctcccggcttttcgatagcaggtccactagtcgtcttgatgttgaccgccatttcattggcgatgaccatcgccattgtcgtctttcctaatccaggtggtccgtaaagcagcacatgatccaatgcttcttcccgatttttggctgcttgaatgtagatcgacaactcttcttttactttattttgaccgatatattgcgcgagaaactgcggacgcaatgatttttcgatcaattcttctgtttcattcgtttccggtgaaacaatccgttcatccgtcacctaactcgctccttattttttcatcatcaattttaatgcttctcgtaagtattcatctgttgatttagtcgtattaggcgctaaatatttctcagctttcttgatttctttttcactatagcctaatgctttcaaagctgccatcgcttcgtccaacgcggtattcgccacagtgactggtgccgttggctcttcaccgactaattctgcgacttttccttttaagtccaatatcatttgctgtgctgtttttttgccaacacctgggaatttggttaaataagtgacatctccgttttcgacagccgtgatcaatcccgcatggtcttcattcgccataattgccaatgcacttttaggaccgatcccagagacgctgatcagttttaaaaataattgctttccttctaatgtagaaaacccgtataaactatgggcatcttctctaattacttgatgcagataaatcttcacttcttgattcagcttgccgctgaacgcatacggattgccgaatgccacttgataaccgataccgtgcgtttcaacaacgatatacgccggaaagatatccgtgacttttccaataatatattcgtacataaccgttcctttctatacatctagctgtacatacgttccctttattgtagcatagactgaaagacaaaaaaagaagcaagcgaagcttgctcctttactcaacaagagaagtatattctccatatccttgctcagccatttcttccaatgggacgaatcgcaaggctgcggaattgatgcagtagcgcaacccgcctttgtcttgcgggccgtctgaaaaaacatgtcctaaatgggaatctgcttctttactgcggacttcgacacggtgcatgccatgagagaaatctgctttctctttgatttctttgcggtcgatgggcttcgaaaaagaaggccatccacaaccagcatcatacttatctgtcgaagcgaatagcggttcgccgctgacgatatccacatagatccctttttcataaaaatcatcataagtccctgtaaaaggacgttcggtcgcattttcttgtgtgaccgcatattcgatcggtgacaatttcgctatcaaatcttcttttgattctgacatttttctcacctactttcttctcttatcttgccttttttccaatcgtttgtaaacgaacttgcttctttacttaagaagagggcagttctggccacattctggttctttcagcaaaatgataaaacggcggctggtctttcgtatagatttcttctgtgaaaactgcttctgtcaattcttgaaacaaaccagtggcaaagaagaattctgccgtctcctgtgcataataaaataagctagagccacactggcggcaaaatcatctttgcgcccaattagaagagttataccgttgaatcaaggattcgccagtaaatgtgatttgatcacgggaacaagcggccagcgctaaaaaaggaccaccatgaaatttctgacacattgagcaatgacaagcagtcacttggggatgaacctccgttagctcaatcgtaacttgaccacaaagacacctgccggatagattcatttttccagctcctccggaaattcttttaataacttggcaaccgtattaacagggaagccaacgatcgtataaaaatccccttggatcgcttcaacaaacacttttgctgctccttggatcccatagcccccggctttgtcttgatattccccagttttcagatactcggtaatcatttgctccgtcaacagactaaaggatacttgtgcagaaaccaatttttctcgtcgtttttcttgtttttgtaaaacgaccgcagtatggacccaatgagtctttccactcatcttctgcaacatccgtctggcatctgcttcatcagcaggtttgccgaaaatctcctggcccaccactacggtagtgtcactggcgatcacaagatctgtgggaaagcaggctgtgacagttgctgccttttcccgcgccattcgctgcacatactcctctggtgcctctccaaataccacagactcatcgatatctgccggctgtatctgaaaagatgggaccaattccgctaataattcttttcgccgtggcgattgagaagctaagacaatcattccattccactccttgcacgatgcggatcttggatccgtttaaacattcgctccatatcactattggtaaaatgaatcaataccggacgtccatgaggacaattgaagggattctcacactttgcaagatccgccaacaggattcgtgcttgcgcctcatttagataatgattggctttgatcgaacgtttgcagctcatcatgatcgctgttgcttccctgaatttcttgacgctgactgaacctgtctctaaaagcatgtcgatcatttctcgaatgatgctttcttcttctcctgctgggtaccaagtgggatgcgcccttacaataaagctgttcgccccaaactcctccaaatggatcccaacttcttgtaattttttagtttgttccttcaacttgatcgcatcattattgggataatctaagacgatcggtaccaataattcttgcagatcgtcgctcacttctccgattttttcccgaaaatattcatatttgatccgttcttgggccgcatgctggtccacgatataaagtccttcgtcgctttgagcaaacaggtacgtcccatgcatctgtccgaaatattctaaatgagggaaacgttgcttggcaggcgtttcttctaacaaacgatccacatatttcgtatagtttttctgtccggcatgcagttcaggatgcagccgttcttgcgcctgctcttcgattaacgacaagtcctgctgactagcatcctcgagaacagacgctgctggttgatcaacttcttggacaatctctgtcacaggtcctgtcgcagcaaagggatctcgcaacgttttattgggcagtgtttcttccagactatcgaaaactgcttgattttccacagaatatgccgaagactccggagccttttccctttgctccgcgctttctggaagttttccaccttcctccacagggttttccacaaagttacccacagtctgttgataacctgatgacgccacttgaaactttcctgtctcgcggttgaaagttaatcccgaagaagtcgtaggactcgttcccagatccagtttcgtttgttccacaggttcagtggtcacttttttcttaaaacgaagattatcggcagcattcggaatcaaattctcttctcgcaaactgtcattgatcgatttactgatcaatttggtcagttcttcttcttttgataaacgtacttcttgtttagtggggtgaacattgacatcgactaataatgggtccatcgtgatctccaggaccgcaatcgggaatcgtcccaccatcaattttgagccatatccagcgacgattgctttattcaaggcaaaattccgaatgtatcgtccattgatgatcgtggatagataattacggctagcccgggtcacttcaggcaacgagacataaccagtcagcttaaaatcaagatcttcactattgatagctaacatttttttagcagtctcaacaccatagatcccggcgatggtttgtttcaaatccccgctaccagtagtagtcagcattttattgccttcatggaccaagcgaaaagcaacttccgggtgactcaatgcaatacggttcacgatatcgccgatattggccaattctgtctgcaatgttttgacatatttcaagcgcgctggcgtattataaaaaaggttttctacagtgatcttcgttccttgccgcaagttcgctggtatatgttcttccacagtgcctcccttcaaccgaaggaatgagccttgagaagcatctttgacagctgtttcgattgttaaaatcgagactgaggcaatacttggcaatgcctcaccgcgaaagccaagtgtccgtatccgaaacaagtcatcgcggttatggatcttgctggtggcatggcgcttgaaggccgtaacgacatcttcttcggcaatcccctcgccattatcgatcacctggattttgcgtagaccggcttcttcaatgaagatatcgatctgtgtgctgccggcatccactgcattttccacaagttctttgacaacagaggctggccgttccacgacttcaccggcagcgatttgattcgctagacgttcagataattcttggatcttgcccatctgttttccttctttctagattcgtttttgcaattcataaagcttatttaacgcatccattggggtcatttctaagagattcagttttttcaactgatcgatgacgccaacttcttctgtggacacctcgctaaacaatgaaagctgttgtgtttcttctatcacaggcttttcgatcgttggttcatgttcttccagagctttcaagatcgttgccgcccgttgtagtaatccgctaggcagtcctgcaatttttgccacatggattccgtagctcttgtctgccggaccttccatcattttatgcaggaagacaacttcaccgtctttttctaccgctcctacatgaatgttccgcaaacgcagtaattcttcgtccaatatggtcagttcgtgataatgggtcgaaaaaagggtcttcgctttgacttctttatggatatattcaatgatggcttgagcaagtgccatcccatcataggtggctgttccacgccctaattcatcgaataggatcaaactgtttggtgtggcatgacgcaacgcctgattggcttccatcatctcgaccatgaatgtactttgtccagcaatcaagtcatcgctggcaccgattcgggtaaagatgcggtcaaaaatcggcatttctgctgattgcgcaggaacaaaacaaccgatttgagccataatcactaacagtgccaattgccgcatatacgtactcttaccagacatattcggtccggtgatcagtaaaatatcggtgtcttcatgcatcacgatgctattaggaatatattcttggtgccccagcactttttccacaacgggatgacgcccatcgacgatattcaaggatcgctcttttttcaaaactggccgtacatattgatagcgttcagcaattgtcgcaaaactttgtaacacatcgactgcactaatggctttggctaatttctgcaagcgaaggatactttttttcacttcttctcgtacttccaagaacaattggtattccagatccaccgatttttcttccgcttctaaaatcactgtttccagcttctttaattcaggtgaaataaaacgctccgcattagcaagggtctgttttcgttcataacggccttcttcgagaccagccagattggctttggtgatttcgatgtaataaccaaaaacacggttgaagcccacttttaaattcttgatgcctgtttcttggcgttctttggcttctaactcagctagccactgcttgccgttgcgcatcgcttcccgatacttgtctagttgttcgtgaaagccatctttgatgacatttccttcagtgatctgcagcggtgcgtcttcatcgatggcgctatcgatcaatgccactaactcatccagtggctccaattcgatcaacaggtcattccactctccacgattgatgcctttgatcaactgggcgatcagaggaacttgctgcaaagaagatttcagctgcagaagatcccgtccattgacattgccaaagacaactcgcccaactaagcgctccatgtcatatacttttgtcagtgcgtcttgtaagtctgctcgttcaaaaaagctgtccaacaatgattgaaccatttcttgacgtgcaaagatcttctttggttggatcaaaggacgatccaaccactgcttcaataaacgggcacccattgctgttttggtttcatctaataaccataagagtgttccatgcttttggccagttcgaatggatcgactcaattcgagattgaactttgagtaatagtccattttcaaagaatgatctggttgatattctactgcttgctggatatgagccaagctgcgtttttgggtgattgcgagataactcaataatttgccagtgaccgtcttttcatcttcaggcaatccgctagtcaaaaaacggaattcagcattttcttcatatgtctcttgttttgaaaaaacaacactcaagcgagtggtcaacagttctttaagggagtcaggaacttcgctgcacaaaacgacttccttggtttgtaaggcagcggcctcattcaataccgcatcctcgtcttctaaaagcgcggtctttaactcaccggtactcaagtctgcataagcaaaactgtaaccttgcgtcgttttcatcacagccgtcaagaagttattatctttggcggacagccctttgctatccatcactgtccctggagtgatcaattgaacgacttcccgtttgaccattcctttggtggttttgggatcttcgacttgttcacagatggcgactttatagccttgttcgatcaacgtatcaatgtaattactggcggcatgataagggactccgcacattgggatcggttcttccgcatttttgttgcggcttgtcaatgtcagctccaagatttgtgcagctttgatcgcatcttcattgaacagttcatagaaatctcccagacgatagaacaaaaaagcatcttggtattgtgccttgatgcttaaatattgttccatcataggagtgtttttagttttttgaggcatgagcatcttcctcctcgatggctttattcacttgcttttggatttctgttgtgacgtagtgcagcaattcatctgcttcctgaagtgccgcacgataggcgatcacgagtggatgctggtcatattgttgggtcaactcagccactcgtcgcaaagcatccttttttgcttccggtttatcataatgttcatactgaacgatttctttttgggtttgcttgattgcttcttctaactccagcagtttttgattcttttgcgcccgttgttgaatcctttgaaactcttgtactaccgggtgttgtgccaataattgccgcaacgcagccaattcttgtgctactgctgtttctttttctaatgggtccatgattctcctattctgtaaaaggccggtcttcgctgatttggattggacgaatcgatttggcttttccagtttgttcatcgatctcgatcagacaagcggacaaaatactgcgtccgttctcgatcacttcaaatcgttgcggcaatgccgtcaagaatttttcgatgataggttctcgtttcatccctaaaatcccatcataaggaccagtcattcctacatctgacaaataagccgttccttgtggcaaaattcgggcatcattggtttgtacgtgggtgtgtgtgccgacgactgcagaaactcgtccgtctagataccagcccatggcttgtttctcactcgttgtctcaccatgaaaatcaacaaagataaatggtgtacgcttgcgggcgatagtcaccaactcatccattttacgaaaagggtcatcaatgtcgaccatgaaagagcgtgcttgcatattgatgactgctaattcgatcgcattgactttcacaaagaccattcctgtaccaggagtcccttctggaaaatttgccggacgaatcattttttttgcatcaccaataaattcaaaaatatctcgattatcccatgtatgatttcctagtgtgatcacatcgacgccatcttgaagaaatttcttataaattttccccgtgatcccccgacccgcagctgcattctcgccatttgcgatcgtcacttgcggccgataggctttcttcaattttggtaaatactctgtcaaggtatttctccctaacgatccaaccacatctccaataaataatacccgcacactttttcctcttctcttttaacatctttctttattataagtgtttttcttgagaaaaaaaagagctattccataacagcaaacaaccttaaactacaggaattccttcctaccgactgctcttgttgctcttctaggaccctttagaaaataaaacactctccaaataacgttggtcgtttggagagtcatcattattcagcaacacgtttcacgatcgcaacgattaagtcccgcgcctttgccatcgcttcaacagtgataaattcatattgaccgtggaaattctcgccgccggtaaatagattaggggttgggatccctttgtaagtgattttggacccatctgtgccgccgcgaaaaggggcttcgatcggtgtgatccctaagtctttcattgcttgacgagcaatgataacactttgaggattttctttgattcggtcgcccatattgtagtattgatcatacagctgataggtgatccgctcaccatagtactcattcaacttttcaatgatctgcaccatcttctccttgcgcttttggaaaagcgtttgatcgtgatcacgaatgatgtaggagagttctgcttgcccgatatgtccagaaagattgtgaagtaagtaaaagccttgatagtcttttgttttttccgggacttctgcttgcggcagtgccgcatcgatctggttggcgatctttaatgcattgacgagacgaccataagccgtcccaggatggacgcttgttccgttgatttggatatcgatccgcgcagcattaaaggtttcatactccatatgtcccacacgaccactgtccattgtataagcaaaagccactgggaaatcggctgggtcaaacagatccgcccctttcccaatttcttcatccggaccaaaagcgatccagacatctccccgttcttgtggatcaatcgtttgtaaaatccgcaatgcatcgatgatctcagcaatcccggctttatcgtctgcacctaggagcgtcgttccatctgtagtgatcaacgtctcacctatgtagtctttgaggttaggaaactcagcgactgtcatcatgatccccaacggctcattgaggcaaacgtctttgccatcataattttcatggatctggggttggatgttttcggctgcaaaatcagcggtgtctacatgtgcgataaatccgacagccgttttgtccggatttcctgcaagacgtccgatcacaaagctattcttttcatggtacaacacatcgttaagccccatagactgcaattgatcccgtaataaaagtgccagctcaacttgtccaggggtagtaggaattgtttggctgcttgcatcggaacgggtattgattttggcataacgcaaaaaatcggcgatcattggtttgtccttcactttcgtcacttccttcaaaaagataatggtcgatggtccgtttcatggatgatctgtcggaaatctgcaaatcctgcatctaatcctcggagcagcatttctgctgtaccgatattcgtagccaacgggatttcataaacatctgacagacggatcaatgcggtcacatccggctcatgtggttgcgctgccaatggatcgcgcaaaaaaatcaccatatccaacgcatcctccgaaatcatcgccccaatttgttgatcgcctcctaaaggaccagacttatagcgatgaacggatagtcccgtagcttcttggattcgttttcctgttgttcctgtggcatataattgatgctgtgccaagatttcgcgataagcggtgaccatcttcaccatcaattcttttttgcggtcatgggctatcaatgctattttcatcttcactcctcctcttttttccattgtaccaatacttgctgaaaaaaagaaactgtgctcccaagaataagacattgcctaatcttacacagagcttccatcatagaatcaaccggatcccttagtaaaataggtaggctgccaccttaagaaggggcaccgaaggaaatccttctggcaatttgcggggctgatttctctgatttggctgttgcaaaaaatttcaggtttgtctgtttcttaggacacagtttgtttaaatcaagtctagttctttcaatgcttgccagatgccatcctcatcattgctggcggtgactttatcagcaatcgcttgaatctcgggagccgcgttacccatggccacgccgacgccggcagcttgcagcatttcgcgatcattttggccatcgccaaaacaaatcacatctttttgtgagattcctagttggtgtgccaccgaaagaatcgtggctgcttttgaaccatcttttggcacgacatcgacactgttttcatgccagcgaacaaaacgtaatttactgtagcgatcgtcaaaatagtcttcatactctttcccataaaaagccaacgcttgatagacttctttttcttccggaaagtgcatgtctaattcaggcaattgtgcgccaaaagagcgcattgcttcatccatgatgccaatatttaaagaagaagctcgtttagccgtatccattcccacaaatgcggtatcgatccctaactcgtttgcttcagcaacaaatgcttttagctgttcttcatctaataaatttttgtacacttgttggtgtgccaaaaatgcagcagcgccattgcataaaatataattatcaaaagcaagggagcggatgatgtctttcgcatggaaacgactgcggcctgtagcaactgtcacgaaatgcccagcatttcgcagcaactccaatgcttcaatcgtactttccaacggttgcttgttcgaatccagtaacgtgccatcaatatcaaaagcaaagaatttccgattcatatccataaaaaactaagactctctttctgtaagaaataacaagaatttttacttttggatcatgttctctccaaaaagcataccctattcttaacataaaaagctgtctatttcaataagtggcggatcttggtgaatgactcttgcttaccaatgaaggtggctcattttttggggaaactgaaatattttcaaccacatgaagtgtttgcctcaatcgtctttgtctatttggcagtgactggttgagtgccccagacttcatctgccacttcaatgatcagctgcaatttcttccattgatcttcttctgacagaatgttgccctcctctgttgaagcaaagccacactgcggactcaagctcaaacgctctaagggcacgtattggctggcttctttgatccgggcaatcaagctttctttctcttccagagccccatttttacttgtgactagaccgagaacaactttctttgtttctgggacaaatcgcaatggctggaagtccccagagcgatcatcatcaaactccaagaaaaaggcttcgaccgcttcatgtcccaacagcgaatccgcaactggctcatagcctcccgatgccgcccatgtcgaatggtaattgccacggcaaacatgggtagtcacgtgcaggtcgttaggcagatccaccaatgcactgttattcaaccgcagatacaattcttgtaatttttgtgtatcatactcatcgttggtccttgactgccagtaatttttgtccaccagcatcccccacgtacagtcatccaattttagatgacgacagccaagatcatacaaggctaaaatggtttcacgataggcttgcgcaatatcagcaagcaatacttcccgatccggatagatagcgttcactttttcttcgttgctgcctcgaacaagttcgacaaacaattgagcaggcgctgggatactctggcgaacaggcaccccatctgcttgagccgcgacaaagcgatattcctcaaacacgggatgttctggattgaatgcgactttcccagctaatcgtgcagaatcagcacgggtttcttccccatggaacaagtagccttgatccatcaaaatatgctctattccttgaaatccccagaaaaaatccaagtgccaataactacggcgaaattcgccatcgctgacatatttcaagccaacttctttttgttttgcgactaactcactgatcgcctgatcctcaacttcttttaactcggatcgagtgatttttccttcagcgaacgcttcccttgcttgcttcaacttctccggacgcaaaaaacttcctacaatttcataatgattgatcacttggcacatagtttctcctccttttttgggtaaaaaaaaatccttaagagttatctcttaaggatgtaataaatttacatggtaccaccttagtttgcatccgacttacgaagaatgcctctactccaatgcgacgctgttgcgtgatattggggtctcagtaacggggacatccgtgcgcttctaaaacttgcgttctcgaaacacccactcaaaagccattttcagattcgttttctttcaccctttttcagctgtcggggctctctgttagaaattccacagaatcttactttctttttctacgtgtttacttattgatttttaacaaggatagcagaatgattttagtgtgtcaatattgattttaaaaaaaagaagcattgctgcttctttcttcgtttaatccacataagttgattttgattgattgagccatgcatagcccagacccatgatcaagccgccaccgatatagttcccgataaaggcaaagacaagattgtgaatcacgctgccgacagtcataccagctaagtggccgccagatgcccagaaagctaacgtaaacgctgggaagttagcgatgacgtgttcatagcctaagaaggcaaagataaagataatgaaaataatcgcagctactttccctgcatcatctttcatccgcatacttactaaaacagctgtattaacgacaatgtttgcgaacattgcttcgacgacgatttggagtgtcggcttatcaagttttgcggtaatggaagtcaataagaaattatccgcaggcaacccttgaaaaggtccagtcaaagaaataattgatccaaaaatcaaaccaccgactaaattgaagagcacacaagtgaacaaaatcttcaatgccaaaggaacactcaatcgtttgcgataaacaccgacggtcatatacaacatatttgatgtgcctaattctgcgttcatatataagatcatgacaagggaccaactaaacataaatgcatacaacatttttcctagtccatgtgcaatgtcctcacctttcatagcaatcgcaaaggcaatcgctgttcctagcgtcaagaaaagacatgccatcatggcccgtacagcatagcgtaaataactgcttttgatcaaatcgaccttcttttcaatggaagaatcaattttttcaaataatggggatactggattcatttttctgctcctttttatgggtatgataattgagttcgttataaagtacacaataccttcacattttaataaccaaacgcctatttgtaaagtgttttctgaaaaacgttactttttatatgaaattttcatcacattttcattgcaattgaattcaatcataccttgacttttcctcttattttatcgtatactgttccttgtgtaaaataatgcagcagggaaataacagctcgtcaccagttcgttgcctaaaaggttcaattgcgtaaccgcggctgcaaaggtgaagattgaagaacgaactgcacggatgtgaatttttcaacggattattttactccaaactatatttattggaggaactaaattatgtctcgttatacaggaccatcatggaaaatttctcgtcgtttaggaatttctctttcagaaactggtaaagaattggcacgtcgtccttacgctccaggacaacacggaccaaacagccgtggcaaaaaatcagaatacggtatgcaattgactgaaaaacaaaaacttcgtcatatgtatggcatgaacgaacgtcaattccgtacattgtttatcaaagcaagcaaaatcaaagaaggtaaacacggtgttaacttcatgatcttgttagaacaacgtttggataacgtcgtttaccgtttaggtcttgcaactactcgtcgtcaagcacgtcaattagtaaaccatggccacattttagtagatggcaaacgtgtagatatcccttcttaccatgttgaagttggtcaagtgatcagcgttcgtgaaaaatcacaaaacatctcaacaatcaaagaagcaatcgaagcaactactggtcgtacagcatttgtaagctttgatgatgaaaaattagaaggttcattgactcgtttaccagaacgcgatgaattgactgcagaagttgacgaagcactagtcgttgaattctacaaccaaaaactataagaattttcaccagaagctgcgacagaaatcttgtcacagcttctttttttataaattgttagaaataacttcttcggaaagaagtcaaaatttcacagaaatccgacaagcaattttcgaactctccttttcatctctcttgaagcagactacttctgacatgacctcttttttgagaaatcaaaaaaactgtgctggtttcccgaaggaaataccacacagttcgcgattaatcggcaggtcgacttcaaataatattgacgacggactctccggatgaatttttttgatgatagttgaacaacagcaaatctttctgacgctttttaaagattactttccgaatattgcgtggcacaaatttgcggatatcatcttcattatatcctacttgcagtttgtcgccatcaacaatgatgggacgtttcaataaattcgggtattgctcaatcaacgctaataattcttctaatttcaagtcatccaaatcaatggctaatttttgatacacttttgaacgtgttgagataatatcttctgtcccgttttttgtcaaagaaagaatttccagtagttcatcactatttaatggatcgctaaaaatgtttctttctttgaagggtagttcattttcggtcaaccaagcccgcgctttgcgacatgatgtacagctaggcgttgtgtatagtgaaatcattgatcattcttcctttctgatttttctgcggattcttattgattatctgtgattttttcgatcgtttcttgtttgacgacatccacgatgcgaatgttgatttctttgacttctaaagcagtcaaccgactaacttcttgcaaaacaatttcttggatctgagcaaacaaccggggaatatccttcccgtaggcaacaataacttccaaatcaattgctacttgttctttgccaacttccacttcgatccccgatgtcacattgctctggtcggccaaatcttccgtcatacttgaaaaaaattttccatctgcactgattaagccatcaattgacgccaaggctacacctacgatcgtctgcaagactttctcctcaaaggtaagcgaagcagtctctacatttgccgcttgttcattttccatttttcacactccttgtttgcatttctgaaaaaagaacgttttttttagtaacagatccaccaaaaccaacaaccttttgcggttatctgccaccataggtaaaaataccctcctctattagcatagaagttttttgttttttttacaaagaaaaacacttgttaccggatactttttttgcaaattaccgaaataaggtacgtttttttaatataaaaaagcgattccagaaaatattttcctcgatcgcttcttatattttatctgatttatctaaaaagattcttcctcaatcctaccgctcattcaaccttgtatagctccggtcagaagacacttccttataagctggtcgcatgattttttgggcattgactaattcttcgattcgatgagcagaccagccgacgattcgcgcaatcgcaaacatcggtgtgtaaagttcttctggcaagtctaacattttataaacaaagccgctgaaaaaatcaatgttcgcactgacgcctttatacatttttcgtttttgagcaatcacttctggagcgattcgttcaacagttgtgtaaagttgatattcttgccaagcgccgatgcctttctcttgtgcgagtttggctacataatttttaaaaattgccgctcgaggatcattgtcactgtagacagcatgtcccataccatagatcaagcccttgcgatcaaaagcttctttatccaaaactgcttctaaataacgacgaactgcagcctcatctgttgtatcagcaatctggcgtttcagatcactcatcatctccgtcactttgatattggctccaccgtgtttaggcccttttagcgaccctaatgcggctgcgatcgtcgaataagtatcggtaccgctagaagtaactacccgagtagtaaaggtcgagttgtttccgcccccatgttccatatgaagcaccagcgccatatccaaggtttgagcttcttgaaaactataggctttattaggacgcagcatggtcaaaatcgtttctgccgtgcttaattcctccgaagggcgatgaatatacatacttccctcttgattgtagtgattataggcgtggtaagcgtagatcgccagcagtggaaagacactgatcagcatcaaactttgctctaatacattctcaatactgacatcatcggcttgcggatcataactggctaatgtcaaaatactgcgagataaactattcatgatatccgcagaaggtgctttcatgatcacgtcacgaacaaaattggttggaagcgtacgtttatccgccaataactgacgaaatccctgcaattcagataactttggcagctcgccaaaaagtaataaatatgcaatctcttcaaaaccaaaccgattttcttcaacgaatcctgcaaccaattcattgatatcgattcctcgataacgtaattccccacaagcctcgaggggcttccccgccacgattttttctggataaatggtagaaatggttgttaagccggctaagacgccttttccatctaaatctctcagtccacgttttacgtcatactctgaataaagattcatatcgatttgattgtgtttctgacacaatgatgaaagatatacgatattcttttctttttctaatttttccacagccatgttacctcctaacatccttacgtaaacatgctactaacttcatttgattcaaaaaataaaaacttttaaacattatagcacgatgtttataaaatgaaatatttttcataattttaattgatttttctttttataaacgtataattattcctaatagattgatatttaaggaggatgcttatgaattggcacacaaacctgatcgtgaatgatcagcgctatacgtttattgatttagcaaaggtcgcggctgactttaacgctgatttaaaaagattgccttactcgattcgcgtgttactagaaagtgtcgcccgtcaccaagatgaagagattactgctgtttacttggattatttggtcaattggaacgctgaacagcccacaggcgtcgtacctttcaaacccgaacgtgtcgttttgcaagacttcactggtgttccagcggtcgtagaccttgctgcgatgcgagacgccatcgttgccttaggtgggaatgcagatacgatcaatcctgagattcccgtgactttggttgtcgatcattccgtccaagtcgattgtgcagggactccggaagcagtggctttcaatacggcgcgtgaatttgaacgaaaccaagagcgctaccaattcttgaagtgggctcagggttcatttgacaattttgaagtcgtccctccagagaccggtatcatccatcaagtaaatattgaatcactttctgatgtgattttggaaaaaaaaatcgctggcgagtcgtttctttttccggatacattgcaaggaacagattcccatacaacgatgatcaatggtctcggtgtattgggctggggcgttggcggtatcgaggcagaagcagcgattttgggcgagccgtcatttttcccgactccagaagttatcggtgtctgttttgtgaacgaaatgcctgccggtacgaccgcaactgatttggcgttgactgttactgaagtcttgcgaaaggagcaagtggtaggaaaatttgttgaatatttcggaaccggttaccaacggttaagtttagctgaccgtgcgacccttgccaatatggcaccagaatatggcgccacttgcggtttttgtccaattgatgaagagaccctcaactatttagctactacgggacgaacacccgaattgatccataaggttgctgcctacacaaaagccaatcatctcttttatgatgcgacggagataccagactacaccaaaacgatcaccatcgatctagccaagatccagcccgcattggcaggaccaaaacgaccacaggaccgtatcttattaccggaagttggcactgatttcgatcgttccctcacggctgacatcggaccaaaaggcttcggtctttcggagaaggaatggcaaaaaagcagccaagttaactggccaaacgagccttccgaaacattgcagacaggagatatcgtacttgcagctatcactagctgtacgaatacgagcaatcccttcgtcatgctctctgcgggattgttagcaaaaaaggcggtagaaaaaggattgaccgtgccaaaatcggtcaagacttccttggcccctggttcccagatcgtaaccacctatttgactgccagtggattattgccttatcttgaacaattaggcttttatttagttggatacggctgtacgacttgtatcggcaactccggtccattagaagcacccgtagcagaagcaatcgaaaacgaaaatttactggtcgcttctgttttatctggaaaccgcaactttgaaggtcggatccatccacagatcaaagccaattatttagcttctcctccgttagtcgtcgcctatgccattgctggaaccatccggaaagatttgacgaaggagcctctaggcgtcgtagcaggacaagaaatttatctgacggatatctggccaagtaacgaagaagtcaatgaatatattcaagcttttgttggaccagaagcgtttcgtgcagcttatgcgcatctattcgacgccaatgagcgttggaaccgtatcgatacaactgccagtgattgttatgcttgggaggacacatcaacatatattgcccacccaccctattttgattccttgaccaaagaattacctatccaaacaagtttgtctgatttgaaagtgttagccaaattgggggattctgttacgacagaccatatttctcccgctggtagcattggattagattctcccgccggcaggtttttgcaaaccaaagctgttccttaccgtgagttcaactcttttggttcacggcgaggcaatcatcacatcatgatgcggggaactttcggcaacattcgtttacagaatcagctggttcctggaagtactggcgggatcacccattattttcctacaggggaaacgatgtcaatctatgacgctgccatgaattatcagaaaaacgaacagtcttgcattattttagctggtaaagattatgggatgggttcttcccgagattgggcagctaaagggacccaacttttaggcgtcaaagtagtcttggcagaaagtttcgaacggattcatcgcagcaatttggtcatgatgggtgtgattcctctagaatatcttgctgggcaaactgccgcttccttgggattggatggctctgaatccttctttatccaactgcccgaagaaccgcaggtcaatcagcagattgatgtgacagccaaacgtacagatgaaacaatgatcacctttccgactcggctgcgtttcgatgcaccagcagatatccgttactggaaacatcaaggaatcttaccaatggtcattcgcaaaaaaatagaagcaggaggaactagcaatgcattctgaagcgtccttatctaacactgttctcacaattccttatatcagtggtgacggcattggtccagaaatttggcaagcagcgcaacctgtgattgatgcggccgtaaaacaagcgtatggtcccaaaagaaggatccactggcaagaagttttagctggtgaaaaagcatttagacaaaccggcgaatggttgccgcagtcgactcttaccactatccaagaggctaaaatcgcattgaagggaccattgaccacaccagttggcaaaggattccgatccctcaatgtcacattgcgccaaacattagacctctatgcttgtgttcggcccgttcgatactttgccggggtaccttctcctttgaagcatccggaaaagacgaatatggtgattttccgtgaaaatacagaagatgtttatgcaggaatcgaatttgcaaaaaatgatcccctcacgaaacaattaattgaggtgctgcaaacacaattcagtgtcaaaaacattcgctttccagaaagcagcgccatcgggatcaaaccgatctcaaaagagggcagtcagcggttgatcagcggagcgatcgagtatgctatcgcacaccacttgccgtctgtcacccttgttcataaagggaacatcatgaaatttaccgaaggcggcttcaaaaattggggctatcaattagcggaaacgaattatgccgatcagtgcttcacgatgaaccaatgggcaacaattaaatctgagcagaatattgaagcggctcaagcagcacttgctgctgcacaacaagccggaaaagtcattatcaatgatgtgatcgcagataatttcctgcaacagattcttttgtacccagaaaaattttcagtgatcgcaacttgcaatctcaatggcgactatctttccgacgcattagccgctcaagtcggcggaattgggatcgctccaggtgcaaatatcaattatgtaagtggtgccgcaatctttgaagcaacccacggtactgcccccgatatcgttgacacaggaaaagccaatccctgctcgttgttgctctctgcttgtatgctcttggaatatatccagtgggatgaagcagcagttcttattaccacagccatcgagacagcaatcaaggaaaagaaagtcacaactgactttgcggcagctatgactgacgcgcattgtttgtctaccaaagcgttcggtgactatctggtcacattgatcactccataatcattcaccgctctcgttgacttgtcattttagacaactcaacgagggcttgaatttttttgagacaactcaacgaaggcttgattgtatttcagttgctagttcccctatactggagacacgaaaggaggagttcacatgaatgaattcaacatacggcaaatcggccaacggattgccagcaaacgtcgagaactaaatatgactcaaagcaacttagcagatcaattattggtcagttatcaagctatcagcaattgggagcgaggcaatacattgcctgacatcgaaaaattgtcccagctagcaacaattttgcagttatccattgacgaactattaggaaatagcggagttgcagtaatgcattaccacgagggagtcgccgattctcaggaaatcaccacgttggcgccgatcattaaacctaaagaattggcagctgcgactcaagcccagccttttgaacttgagttagtggagcaattggcaccttttttgagcagtgaagaattatttgctttattgaaacctataacagaaccgctgaccgaagaagcactagaagaatttttaccttttttagagacagatcatttggaacaattgatgaaagaggactatactttcgcttttctggaagaagcagcgccctacttatctgccactttcttagcccaaaaagttgagcagtctgtctcaaactcgctgtctttgtacgagttggaagatattgccccttttctcgaaaagcaagatctaggacgcattcttcaaaagatcctggcagcgtcagagaatccggagcaacggttgtcagagcttgaagacctgctaccttttctcgatgaatctacgttagtaacgcttgtcggatactttcctgtaccctctgaggtttttgaactgtttaccccttttttggctacagaaactttgttgcaagcgttgcgaaaaaaacgttgatttactctttacttttcgttaaccaagatttataatttcgttaaccaactattggattatgtgttaacgaaagaaggatactatgaaactaccattgcgagaacaaatctatgctgctttttttgccatcattattgctgggctgtctcaactaaccatcccattaggattgattcctctgacaggccaaacctttgctgtcggcttggcggtaacctttctaggaatgcgcacagggaccatgtcgatccttatttacttattgctggggttgatcggattaccagtttttgccggcggagcaagtggcatcggcgtcttattcggacctacaggcggctatctgattggttttatctttaatggactcttgacggggaaacttttggaaacaggccgcgccggatatgtgagagggatgttagcgaatatcgctggtgcattagcaacattgttttttggtaccttatggttaaaatggagcaccgctatgtcttggactgctgccatcaatggcggttttgttctcttccttctgcccggtgtgatcaaagccattgctgcggcttatttagggattttcttgcggaaaagattgcagcggtaaaaaaagagaaagtagcaaacgtggactgcttcaagcaataaaaaggaattgccgaaaattgctgctttatttttttgaaatttctgcttatttccgaagaagctactgttagtcgtttattcgaaaaaaagagggactgtgccataagtcatcatccaacaagttaaaccgaataatagtctgttgctaggatagattcctctgacttttgcgacgaggagtccctgcaccgcaggagcaataatcattaatgttcggatagttttacttgtaggagacttatgacacagtcccgcacgcttttatctcgtagcgaatcaatagttgatccatgtgattgcttgctggagctctgctcttaaatgggctgctttgtattgattgaacgctgcttgattagttcgcaaaagtccccgtagctttgttggctgaaaattttctgtcaactgattttccagaacaaatcgtcgggtcaattgccattcatagtaatagcccaaaggacgacagctataaatcgtctgtccaatcacttgatcttcaaaccgacgatgggtatgaccaaagactacttgacgcacattgtccgcctcatcaataactgccccaaattctggtgaacctagaaacgcgttcaaatgattccaacgaacatacttccccgtttgtttgacgataaaggttgctttcggaacaaaatgagtcgttacgatgacttctttatcttgagggagccctcgcaatgtttgacgcagtctttcattgatctgatgactgatttccggatcggttcctgtccgctgaatcatacgatcataccaaaagaggcgcttgagacgaaggatctcttctgtgctttgcaagtcagaatagccgtagtcataccagccattgacacctaacaagagtgttttttccgataaagcgactgtttgaaagttcaagaaagctggatcaggataggtttcgatcaatgattctgataaatcagccatttcatgattgccccaatgaaaggtagtaggcagctgtctttgaaagaaatcaatgacggtcatcgctgctgtctctttgtttgcaatatctccagctagatgcaagtgcgtcgcttgattggcgtctagcaattcggctatcagctgcaagtctgttgcactgaaatgattgatatcgacatgcaaatcgctgataacggctaatttccccatatcagtttcctgccacctttttgtccatgcgcaacagttgaacgttagatgccagcagaccgctgtcactagtcaactgcaagcgctgatagtcaggatcgaccaccaagcgtgtccgctcttctaaatacattgctgcgccttgttttaaccaaactgttccaattgctgtatccagcttcgtatcatagatagacaatccttcttctggataatctgctggtacgaggatcaagcgaaaactaatatctaaccggcaagagatcgccgtagccggaaaaggtcccacaccatcttcaaaatctagataaattcgatctccctcctgtttgacttctgagatttttgctactgctgctgcatccatatcaatcgttatttccatagcgattctcctttacatgattcgtttttgccactcgtctcgggtaattccccgcatcacttcgtccactacttgcccacgaaatcttcgcgcagccggaatctgtgcttccactttcatgccaattttttccatcacgcgaccagatcgatgatttcgctgatcgtgcagtgcataaatacgaacaagcgctaatttttcaaaacccaaagacaaaagcatccgagcagcttccggtacgatcccttgcccccagaaagctttattcaaggtatagcctagttctgccacttcctttagcgggtccacccgcaagtcgatcgttccgatcatattgccactcattttctcttcaatagcaaatttacctaatggcgccgctaaaaaatacattgcaatggcgatttttgtatccacaagtgattgatgcctcggaaaaacaaactccgtcgtttcttcatcacttgcgtattcgaataaatcattggcatctgccatcgtcacaggacgcaaccataatcgtggtgtctcgattcgttgattttctgctaaaatcaataagtggttcttttggatttccatgtttcaccagctttctttctgatcttttttagtctttcttatgacctcattgaaatagctaaatgtttctaataatcgacgctcccttttttgtgctataatataaagcaagaaaacgcttaggaggattttcaatgtccgatgaattggagaaacgcctagatacaggaatgtacgggacacctcgtgttaatccagatgaacaaagaaaatacttgggaacgtttcgtgaacgttgttatctaagtatgacggtagcagaaatgaagaaaaaggacaaccaagaaacgttacagtcggttctccctaactatcaaggggcactgatcttgatcaacggaaaattgcccgaaacgcttcagacgacctttatttcattgattacgaaacaacagctcgattttcgagtggtgactgacgcccagactgctgatcctgacagtatcggtttactgatcgttgccaatgaggcagtgaatgaagaggtaatcgatatcgaagaaaagtatcctcaaaagacaaaatcatcttccgaagaagatcccatcaaagaaaaaaaaccattctgggaacgattcttccgctaaacaaaccaacggatcaattactagtgatccttcactagtacgaacagcaaaagaagttgtattagaaatggtcagctttaagatatttcggcttatttccgaagaagctacttctaaccatttattctaaaaaaaggaacagtgacaaaagccttgtcactgttcctttttcaacttctgactgttaagcggctgttaaaatcgttccggaaaaagcagcttgaggacagacatggttaagcggcggctttgtccttggtacgggtaaatatgcatatgcatagcgggattgaagttcgcttcaataatgccgtatgctcccggatcctccgtgggcttttccttgtcaggaataatcaaatcaatcccactgattcgtgcctgtaatgcggtaacggcatctgcagcgatttttttgtagtcatcattaaattgatcggtgacatcgatcgaatcgccgcccgtgctgatattggaattttcccgcaagtaaacgatttgtcctttttctgggacagaatctatgtgatagccttgctctttcaacatcaactgttccaattcacctaattggatcttctccaacggtgtccgatggtgggtcccccgtaatggatcggtatttttctctgcaactaattccttgatcgtgcgccgaccatctcctattacatttgccggtattcgtagcaaaattgcttcaacttgaccatcgatcacaaagaaacgatactctgttccagcaaggaatgcttcaactaaaatcgactggtcttcagcaaaagctaaacggacagcagcttgatagtcctccaacgaagcgccatccttaaagatcgagattcccacgccatagttggttgttttgggtttgacgacaaaacctctgtcagcaaattgcgggtaagcagcaagcgccttttctacagtggcgaattctgctcctgcaggaacccgaaaaccattctcagctaaaatcttttttgtgaccgttttattggccatgatcaaaggaacgatataacgatccttacttgtcatattagcgtttttgacatattcaacatgttcatcgatcgataatttcaagaactgatcagattcatccaacacttccaccttgattcccttttgaatcgcatcgaacatcaaaatttgtgttgacagttccatgttggtgaagcctgctaactgataaggtttttcccaggcaacttgatgataggatactcctagttcagttgccacttgagcctgacttgacctttggctggcttgatataaacgaccggcaaaagttttgccgggatcttccaacattggcagcagttgatccagtaaaggcattgtcggcagactgatttcctttgcaaaagcgatcaattcttccgcaactactttagcttcttcaagatagatcgtttgattcaatgggtgttccaatgccacttgattgtttttgcgatttccttcttcgacccaagcatcggcatcagcgccctcctctttcgttgctaagtataacaagaaaaggtgcagaaatttcacttgatcttgcgaaataccatacatttcaaagggattgatatcaatattgcgtaattcaatgtaacgaattcccgctgttgctaagtcggcaaccttttgcccccctcgcaggcgaactggtgcataaaactctttttcctcagatagtttgccagtttctaccagctcagcgatatccgccagataggtctcaagagaggcataagacacgttgacatcggtatgattcgtgtagccatagcggctgttacgaatgctgcggacaggttcttgcggtccagaacccgccataaaataattggcttccgtttgcggcgttgctccaaagaaataagtcaaaaaccagcagtaatgcaagtaatttcgggtaactttcaagtaaagttctgttttaaacctacgataatctgtttctgacgacttggtaaataactttcttaaaaaatcatccccaaattcaaaattgaagtggatgccgctgaccatttgcttacgacgcccatacgtccttgccaaaaaccgacgataaagaacatcttcaaaacgatccagctttgcgatcacgatatcctcttctttttccggcaacgcaggcggcatacttaatggccaaagcatctcctcaggtgccatcgaacgataagcaacatcatggatcgcagccagataacgaaatagttcctctgagctttccgcgactggcgtgatcaattccaactgattttcagcaaaatcggtttgtatgtacggatgaaaactacgattgcctaatgcttcaggatgatctgtcccagcaaaacttccgtctaaacgtgcacgctgcgcctcacgttcgatcccataacgcccatcaaataagtagggacgcagttcttcttgtataaaaagtgattttagtgtcatatcattgccctctttgtcttagattcttcttattatagtcaataatccagcagaaaaaaatgaaattgtgcgattctctttgctagttttttaaaaattaccaagtttttacaaattacttgaataaatttgatatttgacctctaaataaagtatacttactatataatagtaaattattatgtcaatattacaacttttttgaaaggaagaatagtgaatgaaaccactcaatcttaccaaacgcgaacgtcagatcatgaatatcttctggaatgctgaaaaacctttgtctgcaaatgacattgcggttcaacaacaggacttaagtaaaaacacgatccaagccgttgtccgaaaattaaagaaccatgatttattgaaagtagctgacatcggctacagcggtactgtcttgacccgcttgtattctccaaatgtttctcaagaagattttctagctgccgaactctctgaacaatcgttgctgaatctagtctcgaatttcattgaaaacagtgaggatgccgagacattgaatgatttggaaaaaatcatcaaagagcggcaagcacagctaaaaaactgatttctgaaacaagttgttcttgttcacagagaaatgtccacgctgaacatttctgacaagacaaggaatctttcttggaatgatttcaatttcaggaacagcagctacatccttttagctgctgtggggaggttttgtgaaccagaagtcacacgtcatctgttacgtattctgctgtggtacttcatgtacatcgcagctgtcaaacgtatgcctataaagtttatttccataaccgatgagctttatgcaagttccttaacaaaaaatatccgaactactactgattactcctaccgttaacgccatcgcgagatgatgaagaggaataatcaaacatagttcggatatttttgtcttatttcaagcgatgaacagcatcaaccttcgttgatgagacctttaaatagcccaacaacaaactcatttggatcaaacggctcaaggtcgttgattccttcccctaatccgaccaatttaaccggtaaacgcaattcattgcgaatcgctaaaacgatcccacctttggcagttccatctaatttcgtcaagaccaatcctgtaacatccgtggtttctttgaattgtttggcttggttcatcgcattctgaccagtcgtcgcatctaacacgagcaacacttcatgaggcgcattcggctctactcgttgaatgatccgtttgattttctctaactcattcatcaaattgactttattttgcaaacgaccagcggtatcaactaatagaacatctgcttgctctgctttcgctcgttccatcgcatcaaatacgacggctgccggatcaccaccagctttccctcgaacgacttccacacctgctcgatccccccaaacgacgagctgatcgattgctccagctcgaaaggtatccgcagctgccaacaacactttcttgccttctgatttgaattgatgcgccagttttccaatgctggtggttttaccgacgccattcacaccgacaaataaaatgacggtcaatccaggttgcatatttagttcgttgacttcgtcgacacccgcttcaccgtaaagatcgactagtttttcaataataacattttgaacctctgccggcttcttgacatttcgcaacttgacctcttgacgcagtgcatccgtgatcttgatcgctgcatcaaagcctacatcggctccaatcaatgtctcttcgacttcttcaaaaaaatcttcgtctacagagcgaaaattcgcgaacagctcattgagtcgttgcccgaaagttttgcgagatttcgatagtcccttcgtgtacttatcttgtacatcctctttgtgaaccgctgttggctgaggttgtacttcaggtttttttaccgtttcactaggtgtcacgacgtcgaatggttcagctgatttcagatcttgtgctccttctgatgatgaagtatcagccgcggactcctctgtttctgttggctgcaacgcggaatcggtagtagtttctggacgagaatccagtgttggttccgtcgattctactgtttgttcttgtgcggaatggtcatctgcgacggatgactcatcgacagatgactctggagattcaactggttcctctacttcgccttgcactttgtcttgctcttttgattcaccaatcaaagcttttttaattttgtcaaaaaatcccatttcaaacgcctcctttcaaaacatatttttcgatgacagttgctacaccgtctgcttcattcgaatctgttaccacatctgcggcttccttgattaaaggcacggcattagccatcgctacaccgagtcctgcatagcgaatcatcggcagatcattttcttcatctccgatcgccatgacttcatcgatagtgatacctaaatcccgagccagcaattcaatcccataggctttcgtaattcctttaggcataaattccagcaaattattccgagttttgattacttcatatttctctctgattgctgaaggaattgccaaaatcttcggatccagtacttcttgatgataagcaatcacagctttattatagagtttcgactcatccagagcttctatcgcatacgggcggcaatccagcaatggattcagcgaaccatagatcgactgattcgttgctgaagtcggcaagcacaaaacgatttcttcggatacgacatccagcggcaaatccagttctgctgcgacagcaaccaattcatgaatatcagccaattgcaaagcggctttttccatgatttctcccgtatcgtttttttgcaccagaccaccattaaaagtaatgctatagtcccctgattcattcaatgacaactcttctaaataaggacgaattgcccgtaaaggacgacctgtgcaaaggacgatttttactccttgtgcttttgcttgggcaagaacttctttatttttttgcgatacttgtttctttccatccagcaaggtaccgtctaaatcaattgcgactaatttgatcattttgctactccttcttgatctgcgacaaaatttccgccttctttgacatcttccaaacgcacagaaacggtcttagatacaccggattcctgcatcgtcacgccatacaacacatctgccgcttccatggtccctttgcgatgtgtgacaacgatgaactgtgtatcattttggaagtcgcttaaataatggccaaagcgtgatacattggcttcgtctaaagcagcttcaacttcatccagcacacaaaacgggacgggacggacttgaatgatcgaaaacagcagtgcgatggctgtcagcgctcgttcgcctccagaaagtagactcaagttttgcagctttttacctggtggttgggcttcgatctcaataccagtatttagtaagtcctttggatctgtcaaaatcaattccgcatgtcccccgccgaacatattggggaaaacttgcttgaactgcagacgaatcgcatcaaaaatctcaccgaaacgtgttttgacttcttcatccatctcggacattgtatcgaataattgtgcttttgcagaaagcagatcatctctttgactggtcaagaagctgtgacgctgttccacttgatcatattgctcgatagcattcaaattgactggtccaatcgcatcgatttttccttttagatcttggatttctcgttttgcagcttccgggtcatcgattgctggatagtcattggccgctttttcaaagctcaatgcatattcttcctgcaagtaagccaaccgattatccatcaccaaatccgcgcggtttttctcaatttctacattggtcttttcggatagtttttctttttgttgcaagtttgccaaactgagagcttcatccaactgtccaatttcctgttggacgatttgtctttgttgccgaatgtccgccaattcttgtgtcagtgttatttttcgttgagtaaaatcactgatttgctgatccaggctttcttccgaaatttcatggtcactcacattcgaattgattgctgctaactgccgttctagcgactgttggcgtgcttcattctccgctaacgcttccgcattcgcagcaattttttgtcttaaatgttccacttgttctttttgaacagcaaaatcagcttgtaattgggcggctgtcgctgctaactggcttctttttgcttcgattaaatcttcttctgcattcatgctttgaatgtcgtgatcgatttttttcagctgctgcgcaatggtttgctgttccgattccaaccgagtcttcttctcgttatactcttcaaaaaaggcctgaatctcgcgattttcaaagtcaaagacttgctgctcttttctcaaccgttccaactcgttggtgaggttttgcagttgattttttagttcgtgttccgtcattcgagccgtttcaccggtggttcgcagctcttccaaggctgcttgagcatcttttgtcaccgtttcgaagtgctgcacttgtttctctgttttttgcaggcgttcatccaattgaacggcttgagccgttaattgctgcaactcattgctttgactaaataggctgccggcatttttcttcgtcgctccaccggtcatcgaacccccggcattcatcacgtcgccttccagtgaaacgacacgatagctatagttcagcgctttagctaatgcattagcacttgtcagatcttctgcgatgacgatacttcccaatagattttcggcaatattttttacatcttcattgaaacgcaccagctcactagcaacgccgataaatcctggtacttgttgtgcttgagaaacagcataactaggtaattggcgagacttgattgtcgtcaacggcaagaatgtggcccgaccaccacgattttgtttcaaataggtaatcgctgctctggcatcacgttcggtttctactactacgtgctgggcagaagcgcccagtgctgtttcgatagcaactgtatattcttctggtacttcgatcaattctgcaacagcacccacgacaccggttagctgctgcttattttttagaactagtctgacgccttgataaaagccagcatagttttcttggatatcctgtaaactccgttgttttgcccgcacttgttggacttggttcattaactgatacatttttttctgtgcatcatcaaatttttctttgttctctttggctttctcttgtaaatggatatattgcttccgctgttcgtccaactgttgctgcacggcttgcaagcgttcattaacgatttctgcggctgtcgctttttctttgatcgctgtcgacagttctgtctgcttcgtaacggctgtttgattttttgccgattcttgctggtattggcgctcaagatatttgagctcattgccgaccgttgcttgctcctgcattgcttcaacatattgactgcgtaattcttcgatgatctctttggccgatttctgatacttttcttgttccgctcgacaatcagcaatcgctacttctgcctcttggacactgcgattcttttgcgacagttcatgaatcaattcagctttttcgtcattcaactgttggaggcgttcactgacggcatccaaggtctcttgatattctgctgtgcttttttgcgtatgcttggagcgctccaacagtacttctttttggccttcggcttgcttcagcccttccgttacttgcaacagctgctgattgagctgctccaatgattcatcgaaggctgctcgacgctgccgcaattgctgcacactgcgttcatcggtattgatttgctgcgtgatttcagccaactgatgatttaatagttccagctgttctgtagctgtttcccacgcccgtttggctgtctggatctccatgacagaaaaagccacgtctacttccgttaatttttccttcaatgacaaaaattgtttggccgcttcactttgagcagctaacggaatcaattgatcctctaactcataaataatatcttgtagacggttaaggttgtcttctgtttcaaacaatttctgttctgcttttttcttacgctgtttgtatttcaaaacaccggcagcttcttcaaaaataccgcgacgatcttctggtttgctgctgaaaatcgcttcgactttcccttgagaaataatcgaaaatgattcttttcctagcccggaatccataaagagttcctggacatctcgcaggcggcaactttgtttgttcaaataaaagtcgctttcaccggttctccttaaccggcgagtcacactgatctcactgtaatccattggtaaatagtgatcggtattatctaaaataatcgttacttccgctacatttaatggcttgcgagtgtcagatcctgcaaaaatgatatcaggcatcttgccaccacgcaggcttttggcagactgttctcctaaaacccaacgaatcgcttcagtaatattgctcttgccgctgccatttggtcctacgaccgcagtcacactattttcaaaatcaatgatcgtgcggtctgcaaaggatttgaaaccggcaatctctattcgttttaaatacactccgccattcctttcttattgatcaagacttgctaaggcattttctgccgctgcttgctctgataatttctttgattttccttgcccctcgccaatcagcacatcgtcacaatagacttctgtccaaaagattcgttcgtgggcaggaccttcttctttcgttaaacgatagttgatggacacatcgccagatcgctgcaagacttcctgcaatcgggtcttgtgatccatctcatgggaaaaagcacctgcttttacttttggaaaaacaacagccgtcaagaaaccgtcgacgctctccaaaccttgatccaagtacaacgcacctaaaaaagcttcaaaaagatcgcataacaatgagggacgcttacgtccgccagagttttcctctcctttgcctaaccgaatatattgatcaaaacggcaatctttggcaaacattgataagctatcttcgcgaacgattgctgcccgcagctttgtcaacttcccttcaggaaggtccggcagttcacggtacaaataccgtgagacgatcaattctaaaacagcatctcctagaaattctaggcgctcattatcggataggtgcaaattgcgatgctcattcacataagatgaatgcgtaaacgcttgttcgagtaaatctacatcatggaagacaatgccgtaatcctcttttaattcgttcattagctgtgtattcatttgccacattccttcattagtttatcgacacttccctattatactggtttttggctaattatgaaatgtttcgtccaaaaacttgaagcctccataaaaaaattttaaccgtttattctcctgctctttgtttccatgactgattcattgttttttattgattttgccgcgaacaaaataaaaaaagacgttcccgaaagaacgtcttttcctaaattagcgagattctgctgttacagaaactgttgcccatggattgtgatctgcatcatatgcccatgtgaaatctttgacgcgattagatactggtaatacttggttacggtaaagcgaaggaataacaaatgcttcatccgcagcgtattcttgccatgcatcaaatgcttctttacgttttgcttcatcaaatgattctttagagtcgattgcttctaatagcttcgtattttcatcagattcaaaacgagtgtagttaaatgctgattttggtccataaagtccggttggtgaaggatctgaacctgttccccatgcaccttgatacacatcgatttcaggatcatcatttttcaatttatcatagaatgcttggaaatcaatcaaacgaccagttgtgtatttcacatctaagccgatttcattccattgttggatgtagtaatcagccaatggttgagctgtttcgccacctgacattgaagcaaaattgatggttaatttttcaccgtttttgtcttcacgcatgccgtcgccgtcaacatctttgtaaccagcatcgtctaacaatttgtttgctttgtcgatatcttgtgtgtaacctttaacttctgtatcgtgcaatgttccaaataccggtgggatcaatgttgtcgcatttgaacgtaggccattatagaaacggctaccgacagcatcattatctagtgcgtaacccattgcttgacgcaatgatttgtccgccatttttgattcaggattgtagttaacttttccttctttatcatcccaagtacctaacttaaatccaatatacgtataagcttgctcaggacggcccaagatttggtagccatctgcatctttgtaagttgggtaagtatctgttggcattgacaatgctaaatcatattgcttcgcttttaaaccttctacgattgaagctgctggaactgctttaaatgacaatttatccattttaggtttgccaccgtagtaatactcatttggtacgtattctacagattcaccggctacgatgtttgacattacgtaaggtccgaaaacgattggtgttttacgaacaggatcacttgattccatatctttgactgcaataccttcaaacgcatgttttggtaaagcagaagaccagataccgccgcctgcttgcatcataccagggtgaacttctttgtattgaattttaacgactttgtcgctttcttttgtgattcctgagattgtgtcagatttgccatcgtggtaatcttccatcccaacaatatttgtaaagttgttgtcataacggattcctgtgtaatctttgttaccgatcacttcataggagaaaatcacgtcatctgctgttacatcttcgccgtctgaccatttcaaattgtcgcgtaatgtaatcgttgctgtgttattatcttcatctaatttaagatttgcagccccaccatcaacaattcgaaaatcagcatctgttaagaataaactttcattacttggttgcatgaactgagaatcataattgtcttgataaaattcagtttggaacaaaccttggaattgtgtatccataactactgcgacgtccaatgtaccgcctttgattgcttctgcgtcatttttgacttcaaccggcatagagctaatatcttctgtttcagttgctgagttgctgccgcctgatgaatctgttccgccactattgccgccacaagctgccaatgctaagactgacaaaagtgtgaccataccaaaaatatttttcttcatcctgtatcctccttgttttaacctagtcgttgacgtgcatcggctgaacgcttaaatgcctgaccaacgtagtttatactcaacatcaatactaaaatcaatattgacgcgggtaaccatatccattgtctgttgaccagcacatcaccgctgctggcgtacccaatcaatgttcccaaacttggaacattcgttggcagaccaaagcccaagaacgttagagttgtttcgataccgatatttgctgcaaagttcatcgtcaagttggtgatgatcaatgagcttaagttcggcatgatttcgcgaaacatgatcacaaaatcattggtccctaatgtttttgacgcactcacataatctcggcgcccttcagaaagggtcttactgcggaagagtctcgcttttccgacccaataaaaggcactcatgacccagataaacgtccaaacattgtagcgaggtatgatcgaaacaataacgataatgatcaacatgatcggtaagatcatgacaaaatcgacgatacgcatcaagatattatcaatcaacccgccatagtaacctgaaatgatccccaagccaactccgacgatcgatgtaatgatcgtgatggaaaacccaatcaaaatcgaattacgcgctccaatgatcaattgtccccaaacatcacggccaccttcatccgcccctaataggtaggtgccgccatttggtgagactgctcctggtgcagcatatttatctagaatacttacatgcatgacttggctttgatcaatgactgccgagccgatgaatacgaaaagcagtactgctaccaacaagaccaacgaaaaaatagcgatcttgtcttttaaaaattcacgaaaaatcatttgtaatcccataggtgggatactttcttgttttaacactttttctttcttttcagacacgtttatcccctcctactggattctgattcttggatcaacaatactcataatgatgtctgatagcaatgtaccgatcaatgtcgccagacctaatatcaaagtcaacgaagtgatcacggcataatcccgctgtacaatactatcgataaataattttccgacacctgggtaagcaaagattttttcaatgaccactgaaccagcgatcaatgaagtgatctcataccccatttgagatgcgatcggcaaggatgcatttcggaacacgtgacgtgagaagactttactagttggcacccctttcgaacgagcagttcgcacgaaatccaatgatttggaatcaatcacttcactccgcagatactggatcgtcacagcggtacctaatagcgcagaagtgatagccggtaagatcagatgatacagacggctccaaaactcagccattcccgttacgcctggtgctacagaccccccagttgggaaccaacctaaacgataaccaaagataaacagtgcaatcaatgcaaagataaacaatggtaccgcaaaactaaagaagttatacacgacaacgactttatctaaaatcgaattttggtaacgtccagccaacattcctaaaggaatcgcgatcacatacgttaagataactgttaacaaagatagccacaatgtgttgctgatccgtcctgaaagtaatgttgctactggtagtttatagataaaactttgaccaaaatctcctttaagtgcatttccgatccaacggaaatattgtgtataccaaggatcattcaatccggctgcttcccgcatccgttcaataactgctggatcttggttcggattaatcaatcctgtaaatggatccccgggcattgcttgtgcaatcaagaaaattaagacactcaaaataatgacttgcgggatcattaatatcaaacgacgtagaattgttttccacattattcagcacccccatttttcaaagcgacttgatgtgtttctgtgatggttctaaggtcataaacacgacctgtttcatcatagtaatctttttggtgagtgacatattccaactctacccgacggcggttttctttatgcgcctcacgatttttcacatcaatttgaggaatagctgacaataaccgcttcgtataaatatgacgcggatcttgataaatatcttggcgtgtaccgatttcaacaaaacgacctttatacatgatggcgatattgtcgcacatgtgtttcacaacacccaagtcatgagagatgaataagaaacttaagccaaactcttgttggattcgtttcataaagttgagcacctgtgcctgtacagacaggtccaatgcagaaacaggttcatcagcaacgatcaatttagggttcgatgccactgcgcgggcaacccccaaacgttgtctctgtccaccagagaattcatgagggtatttgtataaagcatcttctggcatcccaacgatatccaaaagccgtttcacccgttgtttttcttcttggtcactcaaacgttcaaaattccgtagcggttcagcaataatatccactacccgctttttaggattcagacttgacatagaatcttgaaaaatcatttgaacatccttgttgtaattcatttttttgcggacagagcgctttgtgacatcttgtccttcgtaaatgacttcaccgctggtaatcttttccaagccaacgattgctttccctgttgttgattttccagagcctgattctcctaccagaccgtaagtttttcccttttcgatgatgaaatccacaccgtcaacagcatagacatagtccgttacgcggttgaaaaaaccgctgcgaatcggatagtggactttcagatctttgattgtgattaattctgacatctacacttctccttcttcgtctctaaaatgaaaatgcttatagcaagtacagcgaactaaatgatctggtgcaacttcatgcaggacaggattttcttcgtggtcactagctgggatccaagggatacgagcagcaaaacggcaaccagttcttggcatgtttttcaatgaaggaacgacgccttcaatcacgtgcagttcactgtcttgagaatcttcttgtggaattgagttcagcaaagagcgtgtataagggtgttttggatttgcaaacaactcttccgctgtggcaacttcaacaaactgaccgccatacataacggctacacgatcagccatttctgccactacacctaagtcatgggtgatcaaaatgattcccgtttgtgtttcagcctgcaaatctttcaacaaatctaggatctgtgcttggatggttacatccaatgcagtggttggctcatcagcaataacaattggcggtttgcatgcgatggcaatggcaatgatcacccgttgccgcatcccaccggataattcgtggggatactggcgacccacccgtgctggatttggaattcctacttgatctagtaattcaagggcccgggcttgtctctgttccgcattcatatttgtatgataagataaaccttctttgatttggtcttcaatacgcatgagtgggttcaaagcggacaatggatcttggaaaatcatcccaatgtcgttcccgcgaattttgttgtaaagtgtttcatttaagtttgacaaattcaagtctttgtataagatttcaccggtgattttggtattgtttggatcatgcaatcccataatcgttgtagctaaggtactttttccacatccggattcgcctacgatcgctaaaatctcattgcgttccaacgtaaaagaaacaccgtctacagcgtcatagtaatcatctttaatacgaaaacctgtatgtaggttttgaacatctagtaattgattatcagttgacaatcgaatacccctctcttttttataagatgaagtgccctctaatgtaaaaaagtaggaattataagtcaaattccaaatgctttcttaacatcgtgtaatattttcttaataattatatagaatcactcactagattgcaagtctataaatttttaagatactgaattttcagaatacttacattccatttacattttttcaggatggtgcaaagaaaaggcactttttttcgagaaacgaatggttattaaacaaattctgataaagaaagagctgggtcatctatgactcagctcctgtatctgtcttaagcaagatggcttgaaatataatcaactgctccgccgactgtttcaatctgttcggcatcttcatcagaaatctccgtaccaaattcatcttctaattctaagacgaattccatcacactgattgaatcagcatttaagtcgtctttaatactcattgtatccgttactttatctgcatcgatctcaaaatggtttgcgatcactactgcaactttcttgaatacttcttctcgcgtcaattgccttcacctccacgcgttcgcacaaaacatagaatggctaacaaacattgtactgcttacatgcaaatttgtctagtccttttttgcattttcattacaatgattgcagtctcattgcgttggctcttcatgcttaggtgtttcttcaaaatgagccaccaattgaggaaccacatctgcctgcaacatggtatagatttgtttgatggttgctgccacggcatctggtccagtcgctccatgtgttttgatcactggtgctttcagaccaaacaagacagcccctccgtgtttggcataatccatctcattttttaaattgcgcaaggcatctttcaataataaagcccctaatttccctttggttccggaattcatgatggattgtttcaataacgacatcatattcaatgcggttccttcaatggatttcaagacggcgttcccagtgaatccatctgtgaccacaacatccgctgcaccgttcaaaagttccctagcttcaacatttccgataaagtgaatcgatgattctttggtcaacaattcaaacgcttttttggttaactcgctgcctttggtctcttccgtcccattgtttagcaaccctactcgcggttgttgaatgcctcggactttttgagcgtaaaaagaacctaacacagcatattgaacgagatgttctgctttattgtcagcattcgctcctagatccagcatatcaaagccagtttctttcccaagtacaggcatcgtcgacattaagccaggacgttcgattcctttgatacgacctacgataaacaaacctgcagctaacaaagcaccggtatttccagcagagaaaatggcatccgcttgaccttctttgaccgcttgggctgctaagaccatcgatgcgttctttttgcggcggatcgctttaacaggttcatcatcactgttgattttttcatcggtatgaatgattgtaagctgactttcgtctgtcacatattttctgatttcatcttcttttccgtataatagaaattcgatttctggatattctttttttgctaacatgacgccttcaacgatcgcttttggtgcgttatcgccacccatggcatctacggcaattttcatgacatacgccactcccttcatttttccaagttagtataccatattctttaatcaaaaaattgattgtctcgtttttctgctgctaaataatcggctagcgcttgatactccggtaaaatctgccattggtgcttctgccagatttgagttgcttctacttgtgcaacttcaagaatatgggcatcggctactaaatcggctgcggcgaattcaggtaaacctgattgacgattaccaaagacttccccgggacctcgcaattgcagatctttttcactgacgacaaagccattggtggtttcagtcatgattttcatccgctctattccggtttcatttttgggatttgccaccaaaatacagtaagaagcatctgcaccacggccgacacgcccccgcaactggtgcaactgagctaacccaaaacgatctgcatcaataatcaacatgactgtcgcattgggtacatttacccctacttcaataactgtcgttgataccaagatctgtaactggttgtccttgaactcttccatgatcgcgtctttttctatatttttcattttgccgtggagaatgcccacttggtagttaggggcaaaataagcctgcagctgctcgtaaatctccgtagcattcttgacatctaacatttctgattcttcaatcagcggacagatcacatacatttgatgtcctttcgctaattcctgacgagcccagtccagcacagattccaattgaggtggtcgtacccaacgcgtttcgaccggaatccggccagctggcatctcatcgatgatggaaacatccatctcaccataggccgtgatggccaaggttcgtggtatcggcgtcgccgtcatgaacaaaacatccggcaaatatcctttttctcgcaatatttttcgctgattgacaccaaagcgatgctgctcatctgtgatgactaaacctagacgggcaaaattgaccccttcttggatcaacgcatgcgtccctacgacaatatcgatctcacctgcagccaattgctccaagatcactcgccgttcctttgtcttggtggaccctgtcagcagtgccgttgtcacttctagcggatcaaataactggttaaggctttccaaatgttgttgtgccagaatctcagttggtaccattaacgccccttgaaagccagctgtcatagtggcgtacagtgcgatagcagccacaactgttttgccgctaccgacatctccttgcagcagtcgctgcatatgttgcggacttttgaggtcatgacagatctcgttggtgactcgcttttgagcagcagtcaattcgaaaggcagtgtctgggtgaaagcttttaaccgctgaacatcatagtcaatggctaagccgttcttttcagccttttcggaaattttcaatccttggatctgcatttgaaataggaagaactcttcaaagatgattcgccgctttgcttgatgactttcttgcggatcttttggaaagtgcatagctcgcatagcagtctggcgatccaataaccgatatttctccgttaaagttagaggtaagatttcctcgatctggtctccgtatgattcaaatgcctgcctgatcaagtcaaccagcacgctttgccgtaccgatttgtttacatgatagataggagcgaaatcacctggcttcttgctgccaagaatcttcatcccagctagtgatttccgtttcgcatcccatttcccgtaaaccgcgatttcttcagacaaaacaactttatcttttaaatagggctgattaaaaaaggaaacattgaatacatcatgatcttgcatcattcgaaactgcagccgactctttttgtaaccaaaacgatttacaacagccggggaaacaacgattcctttgatcgtgactttttcttgatcttgtatctcgttcaattgacgctcttgaatatcttcgtagcgaaaggggtaatatcgcaataaatcttcgattgtctggattccaagcgctgcgagatcttttgctcgcttttctccgacaccagacaaaacagtgattggctgatcaagcatttcttccctcctcaaaactagttgtttgcagattgctttctttattttactcttctctgtttaaattacgaagaatttgaatgaaaaaagatgagcaaaaacaggctgtttctctatcaatcaaaaaagagacggaaacaaaaatcgccctgcgacttttgccccgtctgctttcaagttttattcagccgagaaaagatacggataaacaggttgatctccttgatggatctccacttcgatctccggatagatttctgtcaatgctgcttcgatttttgctgcttcttttgcttttccttcttcgccgataataatcgtaacgatttctgtttcatctgaaatcatcttctgcaatgtatccatggaagcagagaaacaatcgggtacagaaaccacgattttcccatcaaccattcccaagaaatcaccttctgtgatttcaattccatcgatcgctgtattacgaatcgcgtgtgtcaccgaaccactgacaacacttgacaagatttcagtcatcgcttgttgattttccgctaacgttgcttgttcattgaaggccaacattgctgtcatcccttgtgaaatcgtacgggtctcaacaacagcgactgggatgtccgatacttctgctgcttgttgtgcagccataaagatattcttattgtttggtaagacgataacctgatctgcgttcacttcattgatagcagtcacgatgtcttccgtgcttggattcatcgtttgaccaccgctgatcacatagcttgcacctaagctggtaaatagtttatttaatccatcaccggctgcgatagcaatgattgcataaggtgtacgcggacgtttcactgcagcagagggttgatcgtgctccagaattgtttcatgctgtacacgcatattatccaccttgatcttgatcaaagaaccaaatttttggccatagttcatgacttcacctggatgttctgtgtgtacatggactttgataatctcatcgtcattgacgactaaaagagaatctccaagttcgtttagataatttcggaatgtttcataatcaaacgtactgtccactgttggtccttcaccaattttgaccatgatctctgtacaataaccgaatttgatgtcttctgtagccatttgtccttgaacgctgcgatgatgttcggcattgaccatttcatccattgctgctggtgttggttcatagacctcattggcttgatattctccagtcagtgcatttaagaacccttcataaatgaacaataatccttggccaccactatcgactacaccaacttctttcaagactggcaatagatctggtgttttggctagcgcacgttttgctccgtgaacgactgctttcatgacttctacacagtcatcactagtttgtgcttttttctcaccgtattctgcagcgatacgtgctactgtcagaatcgttccttctacgggtttcatgactgctttataggcggtttcgaccccatgtgtaaaggcttgtgccaattctggcgcagttaatgtttcgaccgtggggatcgctttagcaaatccacggaacaattgagacaaaatgacgcctgagtttcctcgtgcgcccattagtagtccttttgaaagagttgtggcaagatcgcccactttttctgaagtggcatctgctactgctttagcaccgcttgtcattgataaattcatattcgttcctgtatctccatcaggtactggaaatacattcaatgaattgacaaactctgcatttacttgtagacgagccgcgcctgcctgcaccatctcttgaaactgacctgcgctgatattcgttaccttcactgataatcctccttaaaatcatccgccgcaagcggatcacttgcctaatctggcagtacacgtacaccttggacaaaaacattcactgaatttgctgaaacgcctagcattgtttcaagattatatttcactttttcttgcacattgcgggaaacttcagaaatttttgtaccatagctaacgatcgtgtagacatccactgcaataccgttttcttcttgacgaacaacgacaccgcgagaatagttttctttgcgtaaaatttcattgatgttgtccttgatctgtttcttgctggccatgcccacaataccaaacacatctgttgctgcgccaccgacaactgtggcgatgacctcgttgctgatttcaataatacctgatgaggttttgattttcacagccataatatagcctccttaagcgggatattcccatctttcttctctcacattttatcatagctgctagtcaaataaaaggatgtgacttatgaaaaggggcttggcatcagatattcttgtattctgaccttgtttaatttacaatgtttactgctaaaagtcaatctttcttgaaaattacccttgcattttctaactttctatgataaattcagatggtatgagctgaaatagcgctccaacatcaaggcaaaggaggaaataaccacatggctaaagtttgttactttactggacgtaaaactacaagtggaaacaaccgttcacacgcaatgaatgcgacaaaacgtactgtgaaacctaacttgcaaaaagttcgcgttatgattgacggaaaacctaaaaaagtttgggtgtcaactcgtgctttgaaatctggaaaagttgagcgcgtataatcttaaccacacattttcggccgttcttgcgagcggtcttttttgttgtcttccgtttcattcctcctttcctttcttatgtcctttgttttttctttaaacagctaatgacattgtttttttaatcctttgaattatggtacactaataaaaaattcataaggattaggtgactattcttggctactatcaaatcattcatcaaacaacattggccttatatgaccgccagttttctgctgccgttactgattatggcagtcatttatttaacgatcggaatctatcccggcagcagccgcagtgtcttagcgagcgatgccttttcgcaattttcgaatttccatgccagttttcgtaatgtcttattaggcaagcagagtatcttctatacttggaatgcctctttagggttgaactatcttgcactgatctcttactatttaggtggtctttttacgccgctggttttattgtttcccaatcaattgatgccagatacgctctatgtgctgacacttttgaaaatcggcagcgccggactcgcattttggttttacgcgagtcaaacatttaaaatccaacggtggcatcatgttacgcttgctgtctgctatgcgttgatgtcctttatcactgctcactccgaattgatcatgtggctagatgcacttatttacctgccattagtgattctagggattgatcggctcttgcaacaaaaaaaaccgactcttctgtttgtcagttacctactgttatttatctcaagtttttatatgggattcatgatcggagtgttctccgtcttgtatctattcgtgcaattaggtcgcgattggaagcaaaacaagaaagcaatcatcccttacggcatcacttctttattagccggtggggcttccatgatcatcattttgcctgctgtacttgatttacgttcaaatggggaagaattgtccactatcacgaagttcaagacagaagctactggtgttttcgatcttgtaatgaaaaatatgattggcgtatatgatacaactaaatacggttcgatcccgtttatttatattggcctactgccattactactttgtattttatactttgtttctaagagaattcctttaaaagataaactgctatatgctggattgtttagcattttgatcgccagtttctatatcgttcccttgaatctcttctggcatgggatgcatgccccaaacatgttcttgttccgctatgcctatttgttctcctttctagtgattcttttggctggttatggttgggaacagctgcagcaaaaagaccgaggtctgtttgtgattgtcggactatctacgattgctctctttgcactttcttatggactgggaggaaactcgtatgaattcgtcaccacagcctcttttgcgttaacgattgttttctttgccctttacttgctgtgtatcggtttcggtcaacttggtatgctaactaaaaagaaagtggcacttctcttgttggttttcgtttgcggtgaaatggcgatcaacacgagtgggatggttcgcggaatcttaaatgattggaattacgcctctcgaagtctgttcactgatccttatccttcaatcaagcaattggtggatcaagccgataaagacaatgagacctttttccgtttggaaaatctggatcccgtttcttccaatgacagtatcaactatggttacagcggtgtcagcatgttttcttcaatccgcaaccgcaactcctctagttacttagataaattaggttttcgttcaagaggaacgaatcttaatatccgttatccgaataatacattgctaatggatgctttcaccggcatcaaatacaatattagcaaacaaaacttaacaaaatacggttttgaacgcgtaggagaagctggagactacaagctttatcaaaatagcaacgctcttccccttgccatgttagcagagccttcgatcaataagatccaacagcctgccaacgacaatctaaccagccagaagaatttgatcaacggtttggcaaacattgaacaaaactattttgattttcaaccgatcactgtcattcacagcaaaaacaccgatatcactgaaaatggcatgtacacgacattccaagagcaagaaagcaatgtggcgaaagagattacttggcaagtagaagtacctgctcattcccaagcctatcttagtctgtatccggcaaacttcggtgaattagagagttctacagctacgatcactgtgaacggggaacagcgggaaagtcaaattggaatcaatggtcaatattatgatctaggctactatgatacggcaacgaccgtgcagtttacggcaagtttctatggcactcagtcaatttctttccaaaacccacaggtggtgacattagacactaccgcctttcaacgggcaatcgatgccattcaagagagaggtgttgcgatgactgtcggcaaacaaaatgccgaagccgatatcactactgagaaagaacagcagcttatcactacgattccttatgacaagggctggtctgccaaactggatggcaaacctatcgctattgacgctttccaagatgcgtttatcagtgtgaagatcccaagcggtacccaccatcttgaactgacttatttaccgcaaggttttgtgatcggagtcattttattctttagctgcctactgctctttattttgttccgctatttctatcaaagaaaagtagcagctgagatagaacacacacccacagacaagccaggcagatgagagcaatcgataccttctttatctgccacaatagcagtcagctgcgaaaagaagcgccccccaacggatcgatacgaatcgaaccttaggaggcgcttctttcttttagttctcttttattcataggctacgcgaaccaaatacaacccttccggatgagcagtaggtccagcggcattgcggtctttttgggcaataatggcgggaatgctatctgctggtaagcgtccattaccgatcttcaacagggttccgaccatgatgcggatcattttatataagaagccatcgcctcgaaaggtaaagagtagttcgtctccggcctcattcacttccatactagcttggtgaatcgtccggactttatcttctacggagctgccagtggcacaaaaactggtaaaatcatgcgtacctaataaatcgggtaaagcttgctggattttcattaggtccaacggatacgggtaatagcttgcgtaatatctacgaaaagggcttcgtggtttgccgatatctacgcgaaattgataggtcttctcccgcacaagatagcgggcgtgaaagtgttcatcgacgattttcacctgtttcacagcaatatcttccggtgtttgtgtatcaagtccaaagcgcattttttctaatggacgttcgtcaaagtcaaaatgaatcacttgacctaaagcatggacacccgcatcggtccgtcctgaaccgtggatttggactgcttgtccattgttcatgcgagtcaatgttttttcgatttcttcttgtactgtgcgtccattgggttggcgctgaaatccttggaaattggtgccatcgtaagcaatcgttgctttataacgtaccatcttctcacctgctttcattttctcaaaaaaatctgaggagccgattgcactccccagacatttacttttatcctcttaataatactaaacctactgtaaagagcacaaagaccaacactacgagtgtgtcgcggttgtgccagtgaagaatccgatacttggtccgcccttcaccgccttgatagcctctagcctccatggctgtagctaggtcctctgcccggttaaaactgctgacaaacaaagggatcagcaatgggacgatagctttcatcttttgcaacaacccgccttctccgaaatcgactccgcgggcacgctgggcattcataattttctcagtctcatccattaatgtcggcacaaagcgaagtgcgatcgacagcatcaaagaaatttcatgcacgggaaatcggatggcttttaatgggcgtaatatatattcgattgcatctgacaactccaaaggtggtgtcgtcaacgtcagcaatgtcgacataaaaataatcaaaacaaaacggcaaaaaatgaacgcaccattctgcaaaccaaattcggtaatattgaagatccaccaggaccaatagacttctccacccgtcgtaaagagaatctgcaatgctacagtgaataaaatcagccagatcaacgggcgaacaccacgaacgaaaaaacccaaatcaattttggaaagaaaaatgctaaatagcgtaaaaacagctgccaaaagatagctctgccaattgtttgccaaaaaaatgattccaataaaataaaaactggcaagtaatttcacccgtggatcgagtttatggataaaggaatctcctggaataaagcggccaaagattagtttattcatcatttgcggtcgcctcctttgctaccagttgatccgcaagttcttctgctgtcaatggcaagtgttcgaaatgcaaccctttcgcttgcaacaacgctgcaaaagcagttgctgttggtacgcctaattgtttttcttgtagccattcgatatcttgaaaaacattcttcggtgcaccctctttaacgattcgtcctttttctaatacatagacataatctgcaaaattagccacatcatccatcaaatgggtcactaagatgatggtcatatttttctcttgatggagtcgctggaacatctccatcatttctttgcgtccttgtggatctaaacccgctgttggctcatctaataccaatacttccggttccattgctaagaccccggcaatggctactcggcgcatctgtcctcctgagagatcaaatggggaacgttcaagaaagctttcatctaaaccaacgagtttaatgtactctttcgctaattcagctgccgcttcttcactcacaccaaaattttggggaccaaaagcgatatctcgagccacagtttcttcaaacaattgcgattcaggaaattgaaagacgattcctacttttttacgcaatggttttaaattcttattatcagtttcaggagtgatcacgcgatcaccaatcgtcactttgcccgctgttggctttaataatgcattcaagtgttgtagtaatgttgatttgccactaccagtgtgacccaccaatgctgtatacgagccttctttgatttcgagatcaatatcgaataacacgcgttgctcaaatggggaatgcggttgataagtaaatgctactttttcaaaacggatgtccatagccaatccaccattccttcctctgtcaagtacgctgcaggcacagagatgccgcgctgcttcaaagctgccttcaatttttctggaaaaggcaaatctagacccaattcgatcaattctgggccagccgaaaagatttctgccggcgtcccttcacgaaccagttctccttggcgcatgaccatgacccgattggcattggctgcctcatcaatatcatgggtgattgacagaacagttaaattattttcttccttgattttcttgatcgttgaaataacttcttctcttccttcaggatcaagcatactagttgcctcatctaaaatgatgatatcgggacgtaatgccacaacaccagcgatggctactcgctgtttttgtcccccagaaagtctggctggttctcgtgttgcaaattcttccatccggacttgttctagagcatttttgactctgatcaccatttcgtcacgaggaatcccttggttctctagaccaaatgccacatcatcttctacagttgaaccgacaaattgattgtcgggattttgaaaaaccattccgaccattttacggatattccaaatattttcttcattaagcagcatgtctcccactgcaacgcttccttcttgcggtaaaatcaaaccgttgatcgttttggccaaggtcgattttcctgaaccgttatgaccgataagcgcaacccattctccttgctcaatggacaaagagacattcttcaacgccggacgatcttcttcggtataacgaacggtgatagcattcaattcaatgatcggcttcatgatatactccttcattccagttaattcttacttacactaccaaaaaagtaagttattttcaatcattccgatgagatttccaaacagaactttgttttcacttgccatgacctgtcaagacagatcatcgaaagtaaaaaaaaagcactttatgatgagtgcgtacacctcgaaatacatcgaggtgtaggcgctgagctagactcggaaagtttcttccaacatcataacactcttaataaacatctataaagtgatgataagtgtgattttaaacaagttctaggataaccattggtgcagcatctccgcgtcttggttctgttttcaagatgcgagtgtagccaccttggcgatctgtgtaacgaggagcgatgtcattgaataatttttgcaaagctgattcaataactacttcttcgttttcttcacgaacgctagcaacttcattacgaacaaatgcggcagcttggcgacgtgcatgcaaatcaccacgtttacctaaagtgatcattttttctgcagttgaacgaacttctttcgcacgagcttcagtcgtaacgatgcgttcgttaatgaataaatcagttgttaaatcacgcaacatcgctttacgttggctagatgtgcgtcctagtttacgataactcacgtggtttccctccttcactttcgtatgtcgtctcgatcagacgagccgaaactaacgtaatcgaagacgtattaatcgtctttacgtagtcctaaaccaagatcgtgtaatttcactttgacctcttcaagagatttacggcctaagttccgtactttaatcatttctggttcagatttattagtcaattcttgtacagtattgattcctgcacgttttagacagttgtatgaacgaacagacaagtctaattcttcaatcgtcatttccaacattttttctttttgtgtttcttctttttccaccatgatctcagcgtttttcgcttcgtccgttaggtttacaaagatgtctaaatgttcggtcatgatttttgcagctaaactcattgcttccaatggttcaattgagccatcagtccatatttccatcgttaatttgtcaaaatcatcacgacgaccaacacgagtattttctacttggtagttcacacgacgtactggtgtatagattgaatcgactggaagaacaccgattggcatgtcttcttttttattttcatctgcttgaacgtagccgcgtccaggtttcacagttaagcgagcatggaatgaagctccttcagaaacgttgcagatatacatatctttgttaaggatttctacatcactgtctacgatgatatcgccagcagttactgtagcaggtcctgtaatatcgatttccagggttttttcttcatccccgtacatttttaatgcaagacctttgatattcaagatgatttgagcaacgtcttcccgaacgcccttaacagttgagaattcgtgtaaaactccatcgatttgaatattggtgattgctgcaccaggtaaagaagataataaaatacgacgtaaggaatttcctaaagtagttccgtatcctctttcaagaggctcaacgatgaacttgccataatctttttcttcatcaatctttgcgattcttggtttttcgaattcaatcattcttatcttttacccctttcaaaacgaaaagtgtcttgttcaatgacgtaattgttacactcaaaatgagcagcactcattaaacacgacggcgttttggagggcggcatccattatgagggactggagtcacgtcacggattgcagtcacttccaaacctgctgcttgtaatgaacgaattgctgcttcacgtccagaaccaggtcctttaactgttacttctacagttcttaatccgtgttccattgctgctttggtagctgtttctgctgccatttgagcggcaaaaggagtagattttttgcttcctttgaaacctaatgaaccagctgatgaccatgctaatgcattcccatgagtatcagtgatcataatgattgtattattgaatgttgagtgaatatgtgcaatacccgcttcaatattctttttcacacggcgtttacgactcactttttttgctgccatgaagttttaacctccttcacttaggaattattttttcttgcctgcgactgttttagacgggcctttacgagtacgtgcattgtttttcgtgttttgtccacgaactggcaatccacggcgatgacggataccacggtatgaaccgatttccatcaaacgtttgatgttcaagttcacttcacgacgaaggtcaccttcaacttttaatttatcaacttcagcacggatagcatctgtttgttcattcgttagatcacgaacacgaacttcttcagaaacgccagcgtttgctaaaatttgttttgcagtcgtgttaccaataccatagatataagtaagtgaaacgaccacacgtttatcacgaggaatatctactcctgcaatacgagccatatttgttacacctccgattatccttgacgttgtttatgttttggatttgctgggcaaatcaccataacgcgtcctttacgacgaattactttacaatgttcgcacattggttttactgatggtcttactttcatgataatacctcctgtggttttacggagtacaattatttaaagcgataagtaatgcggccacggttcaggtcatacggtgataattcaaccgtcactttgtctccaggtaatatacgaatgtagtgcatccggatcttaccagaaacggtcgctagaacttggtgtccgttttccaattcgactttaaacattgcattcggcaaagtttcgacgactgtaccttcgacttcaatcatatcttcttttgccacgcacagtacctccttgtacttgtgattttcacacgataaaatggcggaaacggggttcccacctgatattctcaaactatgcttctacttaataacagtagaagtcggactgacatattttatcatactctgtcaaaggtttcaagagaaagttttgtagctgcaagtcggtgacgggcaatctatgattagtcaatgatgtttttaacatctttaaatacagcatcgatgtcgcgatcaccatcaatcgactgcaataaacctttttctttgtaataagctaagattggttcactgcttttgatattgacagctagacgatttttgaccgtctcaggcttatcatcttcacgttggtagaagtcatgacttccacaacgatcacatgttccttccacttttggcggattgaacaatttatgataagttgccccacaattgcggcacatgaagcggccggctaaacgttctacgagaacttcttcaggaacatgaatatcaatgacagcatctagttttttgtttaggtctttcaacatttcgtccaatgcttcagcttgttccaaagtccgcggaaagccatccaataagaagcctttctctgtgtctggttcagctaaacgctctttgacgataccgttggtgacctcatctggaaccaaagcgccttgatccatgtaagattttgctttcaggcctaattctgtttcgttcgccattgcagcccgaaacatatcgcctgttgaaatatgaggaagaccgtattcagcaacgatacgttctgcctgagtacctttaccggcaccaggtagtcccattaaaatgaggttcattctaattcctcctgtaagtttttgaatagtgttgaggaagacctcaacacttcaataactttaattgataaaaccagtatatttccgtttcagcataagtccttctagctgcttcgcagtatccagagctaccccgataacgatcaataaacttgttccacctaaaccgattgattgcggcaagttccaaaccatctgagcgatgatcggcaacagcgcaactagtcctaagaagaccgatcctactgtacttaatcgcataagcagacgtgagacgtattcttctgttcctttaccagggcgcacacttggaatgtagcttccttgtttttgtaggttttccgctaatttctcagggttaacttgtacaaatgcatagaagaacgtaaacgccacgatcaaaacagtatagatgatcgcaccaggtacggtgttataactaaaaatcgtttgtactacttcataccaagtttcgcctttgtacgaactacctaatgcttgaatgatcgcatttggtgttgtaataaacgaactagcaaagataactgggattacaccggcagcgttgaccttcaatggaagataactacttgttggcgcaccagctactcgcttcgtatattggattggaatctttcgttctgcttgttgtacatacgtcacaaatgtgatgatgaccaaaacagcaacgacaagcaagaccataaacaatgcattcatccaaatatctgatggatccacgttgatgaaataatcttctaccaattccttgatactagcgggtaagcgtgaaatgatccctgcaaagataatcattgacacaccatttccaattccgcgttctgtgatttgttctcctaaccaagtaacgagcatcgtacctgctgttaagatcaaaccaatcaccacaaacgtcgagatatttggattgttgacaaagccaagttgtgtataatagttgaaccctgcagttaacgtcatcgactgaacaaaggccaaaaccaatgttaggtaacgagttgcttgattcaatttcttacgaccaacttccccttgcttcgaccactcaacaaatcttggcacaatatccatctgcaacaactgaataacgattgacgcagtaatatatggtgacacacccattgagaaaatcgagaattgctgcatcgcgccaccgctgaccaagttcaacatgttcagaaacggtagatcagcaatttcccgcaaacggcttgcgtctacgcctggcacagtaatatgtgtacccagacgaaagacaaacaagataagtacggtgaagaaaattctcgatctaatatcttttactttaaaggcgtcctttagtagtttgaacattagatcacctcgattgatccaccagcagcaacgattgcttcttcagctgcttttgagaattttgctgctttcacagtcaatttcttcgttagttctccatttgctaatactttgattccagctttttcatctttgacgattccagcttcatgcaaagcaacaggtgttacttctgcaccgtcttcaaagcggtttaatacatcaagattgataactgcatattctttgcggttgacatttgtaaatccgcgttttggcaaacgacggaacaatggtgtttgtcccccttcaaagcctaaacgtactccgccacctgaacgagctttttgacctttttgtccgcgtccagctgttttaccgttaccagatgaagttccgcgaccaacacggttacgtacttggcgtgatccttctgatggttttaattcatgaagtttcataggtttggcacctccttaatcaaactagatctgctgatccttagacttcttcaacgtccactaagtgagaaacagtgttgaccatgcctttgattgcatcattagcaggttttactactgttgaattcaactttgtaagacctaacgcttttacagtatcgcgttggttttggggacgtccaataatactgcgttttaaagtgattttcaattcagccattatagtgtcctccttaaccgattaattcttctactgatttgccgcgaagtgctgccacttcttcagcgcgtttcaattgtttcaacccttcaactgttgcgcgaacaacgttgattggtgtgttagaacctaaagatttagatgtgatatccgctaccccagctaattccaatacggcacgaacgggtccaccagcagctaccccagaaccttctacagcaggtttcataaggatgcgtccgccgccgaatacaccgataacttcgtgagggattgtagaaccaaccattggtacttctaccaagtttttcttcgcgtcttcgattgctttacggattgcttctggtacttcttgtgctttaccagtaccgaaacctacgtgtccgtttttatcaccgacaacaactaatgcagcaaaacgtagacgacgtccacctttaacaactttagttacacggttaatcgcaacaacgcggtcttctaattccaaatgttttggatcaatataaaccatgaatggtgttcctccttctcttaaaattccagtccattttcgcgagctgcttcagctaaagctgctacacggccatggtaaaggtatccaccacggtcaaagactactactttaataccttttgctgctgcacgttctgcaactaatttgccgacagcttgtgcttgttcagttttgtttccacctgaaatttctttatctaaggcagaggcacttgctagcgtcacacccgctacgtcatcaatgatttgagcgtagatgtttttgttcgaacggaacacgtttaagcgtgggcactcagcagtaccagagattttgttacgtacacgacgatgtcttttctgacgtgttttatttttatctggttttgtaatcacaattgtcacctctttttatttgctagcctaagccgctattcgtaaatgcttacgactatttaccagttttaccttctttacgacgcacaaattcgccaacataacgaattcctttgcctttataaggttctggaggacgaacgccacgaatattggcagctaattcgccaacaacttctttatctgatcctttgatgatcacagaagtgtttgaaggaacttcaatttcgattccagctggcgcttcgatttcaaccggatgagagtaaccaacgttcaatacaagttttttaccttgcaattgagcacggtacccaaccccgatcaattctaacgctttttggaaaccttcagaaacaccaacaaccatgttgttgaagtttgcacgggtagttccgtggatagttttcatttctttactatcgtttggacgagtgaatgttacttcgtttccttcgatattcattttgatatcagaagaaaaagtacgtttcaattcacctttaggtcctttaactgtaatgtcgtttccatcttgtttgatttcaacacctgcaggaagaacgacgatcttattaccgatacgactcacttagaggcacctccttgtggattattttaaattaccatacataagcgactacttcgccgccaacattttttgctcttgcttctttgtcagtgataacaccttcagaagttgagatgatcgcgattcctaaaccgttcaatacttttggcacttcgtcagctttgacataagcacgcaaacctggtttagagatacgtttcaagtttgtgataacacgttcaccgtttttgccgtatttcaagaatacgcggatcacgccttgtttgtcatcttcgatatattcaacatcgcgaacgaaaccttcacgtttcaagatttcagcgatatcacgtttgatttttgaagcaggtacttctaagctttcgtgttttaccatattggcattacgtacacgcgttagaaaatctgcgattggatctgtcatgaccatgggataatttacctcctttatgcgagtatagtttaccagctagctttcttcacgccgggaatttgtcctttataggcaagttcgcggaagcaaatacggcaaagatgaaatttacgataaactgaatgtggacgtccgcaacgttcgcaacgagtatactcttgtgttgagaatttagcagggcgtttgtttttagcaatcattgattttttagccacgtagttcgcctcctttttttatttttggaatggcatgcctaattgtgacaacaattcacgagattcttcatctgtgttggctgttgttacaataacgatatccataccacgtactttatcgatcaaatcataatctacttcagggaagatcaattgttctttgattcctaatgtgtagtttccgcgtccgtcaaacgcttttttgctgacaccgtggaagtcacggacacgtggcaatgaaactgttactaacttgtctaagaattcatacattctttcgccgcgtagagtaactttcgcaccgattggcattccttcacgtaaacggaatccagcaatagattttttcgcttttgtgatcaatggtttttgacctgagatcaattgtaattcttcaacagctttatctaagttttttgcattcgatacagcatcaccaacacccatgttgataacgattttatcaacttttggtgcttgcataactgagctgtagttaaatttgtccattaatgatgggacaacttcttttgagtatttttctttaaggcggttcatctgttagcccctccttcctttatttgattatttatcaagaacttctccggtttttttagaaacgcggacttttttgccgtcaacttctttatagcctacacgtgttgcttcaccgttcgaaggatcaaccaccatcacgttagaaacatgaattggtgcttccatctcgacgattccgccttgaggagctgtttgagaaggtttttggtgttttttaacgacgttcacaccttcaacaacgactttgtctttcttaggaaacgctgcaagtacaacgccttctttgtttttgtctttaccagtgataactttaactttatcgccttttttaacaaacatgtttgtttcgcacctcctttagataagaatcactattacaatacttctggtgctagggaaacgatcttcataaagttgccttcacgcaattcgcgagcaactggtccaaagatacgagttccacgtgggctcttatcgtcacggataataaccgcagcattttcatcaaatttaatgtaagaaccgtctgtacgacgtgctcctgattttgtacgaacgataacggctttaacgacgtcaccttttttgacaaccccacctggcgttgcttgtttgaccgtagcaacgatcacgtcaccaatattcgcagttttacgaccagatccgccaaggactttgatcgttagaatttcacgggcacctgagttgtccgccactcttaatcggctttctgcttggatcacgatgtgtatcctcctttcagattttgcaattcacaatctatataggaaaatctcgtgtgattagataatcactgccttttcaacaatctctactagacggaaacgtttcgtagctgataatggacgagtttccataattttcacgatatcgccaacttttgcttcgttgttttcatcgtgtgctttgtatttcttagaatagttcagacgtttgccgtagatagggtggtttttcttagtttcaacgacaacagtgattgttttatccatcttgtcggataccacgcgaccttggtaaactttgcgttgatttctttcttcagtcatacgctaaatggcctccttccactattactttgcttgttcacgcaatactgttttgatgcgtgcaatcgatttacgtacttctttgatacgtgcagtgttttctaattgtcctgtagctaattggaatctaagattaaacaattcttctttcaattgtttttcttgatctagcatttcggcagtggttaattctctgatttctttaaccttcattcgattcaccacccatttcctcacgttttacgatctttgttttcactggcaatttgtgagaagcaagacgtaacgcttcacgcgcaacttcttcgggaacgccggcaatttcaaacatgattttaccacgttttactggtgatacccatccttcaggagcccctttaccagaacccatacgtaccccaattgctttggccgtataagatttgtgagggaaaattttgatccatactttcccgccacgtttcatataacgagtcattgcaatacgggcagcttcgatttggcggtttgtgatccagtgtgattcaacagcttgcaagccgtattcaccgaaaactacttcttttccgcctttcgcttcaccgcgcattttcccgcggaattcacgacggtgttttacacgtttaggtactaacatgtttatttccctcctttctcagtgttctttttagttggaagaatttctccacgataaatccacactttaactcctagttttccgtatgttgtatctgcttcttcccatgcgtaatcaatatccgcacgtaatgtatgaagtggaactgttccttctgaatagccttctgaacgagcgatatctgctccgtttagacgaccagatacttgtgttttgattcctttagcgccagaacgcattgtgcgttggatcgcttgtttttgcgcacgacggaaagcaacacggttttctaattgacgtgcgattccttcgcctactaatttagcatctaaatctggttttttgatttcaacgatgttgatgtgaactcgtttgccagttaatttgtttaattcttttcttaggttttcgacttcagatccgcctttaccgataaccatacctggtttagctgtgtggattgaaatatttacgcggtttgctgcgcgctcgatttcaattgttgacacagcggcatcagcaagtttagatgcgataaatttacggattttcaaatcttcatgtagaaattcagcatactctttttcagcataccattttgcatcccagtcacggatgatgcctacacgcattccaattggatgtactttttgacccactgattgtccctccttatttttctgatacgactacagtaatatgacttgtacgtttgttgattggagaagctgaacctttcgcacgtggacggaaacgtttcattgttggtccttcgttgacgaatgcttcagaaacaatcaagttttcaacatctaagtcaaaattgttttctgcattagcgatagctgacatcaagactttctcgatgattccagccgctttgtttggtgtgaacttcaagatcgcgattgcttcagcaacgcttttccctctgatcaaatcaataactagacgtgatttacgaggagaaacgcggactgttttagcagttgctttcgctgatgtgatttgttctgccatttttggatatcctcccctcaaaattagcgtcttgttttcttatcgtcggcagcgtgtccgcgataagttcttgttggtgcaaattcacctagtttgtgtcctaccatgtcttcttggatgtaaactggtacatgtttccgtccatcatacacagcaattgtaaatccgataaaacttgggaagattgtggaacgacgtgaccaagttttgatcacttttttcttttcagcgccttgttgtgcttcgaccttcttcatcaaatggtcatcgacaaaaggtccttttttcaaactacgacccatggtgtacctcctctcaaaatgtgcgacacatggtcaagtaaattatttagtcttgcgacgacgaacgataagtttgtctgatttagctttcttgttacgtgttttgtaaccaagtgctggttgtccccaaggtgaaactggagctttacgtccgattggagctttaccttcaccaccaccgtgtgggtgatcattagggttcattacgctaccacgtacagttgggcgtttgcgcatccaacgagaacgtccggctttaccgatgttgatcaattcatgttgttcgttaccaacagagccaattgttgcacggcatgttgccaagatcatacgtacttcgcctgagttcaagcggatcaatacatattttccttctttaccaagtacttgtgcacttgtaccagctgaacggatcaattgtccgccttttcctggtttcatttcgatgttgtggataacagtaccaactggaatattttctagtggtaatgcgttccctactttaatatctgcatctggtccagaaacgacagtcatgccaacttctaatcctttaggtgctaagatatatgcttttactccatcctcgtaatgtactaacgcaatgttagcagaacggtttggatcatattcaatcgttttaacagtagcaacgacattgtctttgttacgtttgaaatcgatcaaacggtattgacgtttgtgaccgccaccttgatgacgaaccgtgatacgtccgttgttgttacgaccagcattgtttttcaatggcgctaacaatgttttttctggtgttgaagttgtgatttcagcgaaatcagaacttgtcatattacgacggccgtttgtggtaggtttgtactttttaatcgccacgtctttttccctcccatttagtatttaaatatggtctgcttattcagcagcgtcaaaaatttggatttcttttgaatcttcagttaaagtcacaacagctttgcgacgtttttttgtgtatcctgcatatttacccatgcgtttgaatttagggcgtacgttgatgatattcacgttagccactttcactccgtcaaaggcagtttctacagcttgttttactaaagttttgttcgcttttgtgtctacttcgaaagtatatttcttgtcatccatggcaagcatagatttctcagtgatcactgggcgtttgatgacgtctagtaagttcattatgcaagcacctcctcgatctgagtaagagcagtttgtgttaccaacattttatctgctgaaacaacatccaatacgctcacgttatcagcagttactactgaaacagatggcaagttgcgtgcagataatgcagcaaagtcgttttctgtttctaaaactaccaatacttttgagtcaatagtcaagttagctaaaacttgtttgaattcttttgtttttggtgcatcaaagcttaacccttctactgctaccaagttatttgaagcaactttttctgacaatacagatttcattgctaagcgacgaacttttttaggaagtttgtagctgtatgaacgtggtgttggtccgaagactacgccacctccacgccattgtggtgaacggattgaaccttgacgagcacgaccagttcctttttggcgccatggtttacggccaccgccacgaacggcactgcgatttttcacagcgtgtgttccttgtcttaatgaagcacgttgcatgatgattgcatcgtagacaactgtttcatttggttcaattccgaagatttcttcgttcaatgtaatttcgccattttggcttccatcttgtttgaataatgctacattcggcattccttagttcctcctttcttcctatctacttatttagctttcacagctgatttgattgtaatcaatgattttttcgcgccaggtacattacctttaatcaagataacgttacgttctgcgtctacacgcacgatttccaagttttggatcgtgatgcggttaccgcccatacgtccagcaagacgtttgtttttgaatacacggttaggtgcaactggacccattgatccaggacgacggtgataacgagaaccgtgagccattggtccgcggctttgtccgtgacgtttgataacgccttggaatcctttacctttcgaagtgccggttacatcaatgatgtctcctgcttcaaaaatatcaactttaatttctgaacctacttctaagccctctagctctacattcttgaattcgcgaatgaagcgcttaggagccgtgtttgcttttgcaacatgacctttcgcaggtttgttagacaaaacttcacgcatatcttggtagccgacttgaattgcttcgtagccgtcattttcgattgttttcacttgtagcactacgtttggagtagcttctactacagttactggaatcaattcgccagattcagtgaagatttgagtcattcccacttttttccctaagattcctttggtcatgattacacctccatcttaattattatagtttgatttcaatatttacaccgcttggcaagtctagcttcattaaagcatcaactgtttttggtgttggattcacaatgtcgattagacgtttgtgtgtacgcatttcgaattgttcgcgtgaatctttgtatttgtgtgtcgcacggatgatcgtgtacaagctgcgttcagttggcaatggaattggaccagatacgccagctccagttctttttgcagtttctacgattttatccgctgattgatctaaaatacgatgttcatacgcttttaaacggatacgaattttttgttttgccattgttttccctccttcgcctattttgaaaagtagacatagctccacgaaaatttccgtcacgctcgtccatggcaaagcgtccgggcgtgtcgcaacctctcgtttcgtagccggcagttttttctttgctgccagtgtgacttacgcatatacgtaaacagcacctttatgattatattatggataaacgctgattgcaagctttttttaatgaaaagaaacgattcttttgcgtttttttcagaaaactttcttttctcttgaaaacaacaaaaaccttgcctaatgacttgctctaagcaaaagcttttccaacaaccatagctactaacgcaaaagcgccccttccggaataattctccagaaaaagcgcttcaaaccactaatcatctcgatttactactagttgattaatcctttagtcacacgttggattgctgcttttaacggaaaataagcaatagcgacaatcaaaatcgtggccactacattgatgactgttgccggcaatttgatgaccgctgccgaccaagctcctgaccagctgctgccaagataccaaagcataacagtatttttgatttgcgtcatagcaagtttcgccaagccagtaacagacccaataaccactaactgccatattgcttgcggacgttttttaaataagagaaacgcaccatatgcaaaagcccccacaataaaactttccaaaataaaataaggggcctctgtcgcatacccattcagcaaatcaaaaatcgcaaagcccagtcccccagcaagggagcctttcacataacctaataataaaactgctaataaaagaacggcattccccaagtgcacaaaggcgccggtgggcaatgggatcttgatcatcgtaccaatgactgtcaacgctgtaaacaatgccacaaagacaatacttcgaattctgtgatcattcatgtggtatcatcctttcttccgcatgattataagcaccgtgccagacgtgaccgacataaggattgatcagaaccccttgtcgaatcgccgcaacgacgaagtctttggccaagcgaatgctttctagtaacggcagcccttttgctaatccagcagtaatggctgcagaaaacgtacagcctgcaccatggttgaaatcagtatcgatcctccggctttctagagtagtaaaagagtgtccatcataaactaagtcaattgcctgcgctcctggcaaccgatgacctcctttgacgacgacacacttcgcgcctaaatgataaatccttttcgcagcttctttcatagcaacaaggtcttttaagtcccccatccccgataaaattccagcttcaatcaagttaggtgtcaccacatccgccaaaggcagcaagtattcgatcaatgcatccacactctttggctgcaaaatatgtgcggtccctttacaagcaataacaggatcgatcaccacctgtttcacttgttgttgctggatcatcttggcagcctgcgcaatattggcttcattccccaacatccctgtcttaacggcatccattggttcccccgtgaaagccgaaatcaattgtttttcgaccaaagaagtgtccatagctgtcacttcgtgggtccatcccattgacggatccatggtgacgatcgaggcaatcgaagcaaaaccaaaaacaccatactcttgaaaggtctttaaatcagcttcaattcctgcgccgcctgttgaatcggacccggcgatcgttaatactttcttcattattatcgactccttttattcagtataaccaatggtccccttgacgaaaacagccaattggcttatttttataccatccaataaaaaaaggagggctctaatgaccgataggcaaatcgataaacagaagaagcaaccactctatcagcaaatcgtcacttactttatcgaggccatccaaaatggcgattacacacctggtgaacagttgcccgccgaacgaaaactagccactcaattcggggtcaaccgttcaacgatcgtcaaggcactggatgagcttcggagtttaggatggatcacgcgcaaacgaggcagcggcacacaagtctctgaaggtcgatggggcaaccgtcagacccctctgtcttatctccgatcgtctctatctagtccctacttacagcaagacccctttgttgaagagattcagcgattgcgcacaaaagaccaaattctcgacctttatacaggtgatctgccacaagaactgcttcctgatttccaatttcctgcctttacttgggagatgatccgcaacgaaagcctgcaaagcaccccagccggctatccaccattgcaagaagtcttgatgcggcacttgacggaagatttcggaatccccttatctggacaaaaactcgtgatcacttctggctccacgcaaggtatcacactgcttatgcaagttttgttgacttcaggtgatagtattcttacggaagatccttcctttttgttttcattgcccttatttacaacaatgaatgtccgcgttctcggaatcaaacaggacgaagaagggatgcgaccgaaagacttagaacaagcattgaaagagcagaaaatcaaatttgtttatttaaatccgacattccaaaatcccaccggtcgtaccatgagccttggccgccgcaaagaaattatcgctatttgccagaggtatcaagtaccgatcatagaagatgatatctttagtgagttagcctttacgccgcaacccgaaaaatttaaggcactagcaccagattcggtcatttatctcggatctttatcaaaactctttgggtcttctatcaaaatcggctggttattagctcctgaagcattggcggatcaatttgctcaagctaaaaaaaggatgtctatcgagacaacgatttttcctcaactgttagctaatcttgctctccgttccatggagtaccctcaacaacaacaggacttgctaaaacagatggctcaaaagcaacatgccttgattcagcgactggacgctttttctgaggattgggcattccaacagaccactgggggactatacctctggctgcaatggcaacacgccccactgaaacggagagactggacacttttcttaaaaaatgattgtctagttgccccagcctttctcttcagcaatgatacaaacggatttcgtctgaactatacacgactttcggaaaatcaactagacttgttttgtcagcaattcagaaaaatcacaacacaattaaaggagcatctgtatgaatgagacaattgatctattaaccaaccaccgcacttatcgccaattcgatagcaactatcaattatcaaaggagcagttagaagcaattttatctgctgcacgacaagcacctagctggatgaacgggcaagcttattccattctcgtgatcgatgatcgttcacttcgacaacagctggttacttggaatccaggtaatcctcatatcgctgaaagttctatctttttacttttcttggctgatttaaaccgcaccaagaaagttgctgagaaaaaacaaacaccttatctggttgatgaaggtctacaaccattgttgatcgcaacaaccgatgctagtatcgctttacagtcagctgccattgctgcggaatctcttggtctaggaacagttatttccggcagtgtccgcaaagacagcaaagcgatcgccgaattgctcgaactgccagaatacgtttaccctgtggctggattaagtattggcaaaccaattgtagatatggctctcaagcctcgcttgcctcaagaggcggtaatccattacaacaaataccaggattattcctatcaagcgatcgaagactatgaccaaatcatgaccgccttcggtgaagcgagagaaacaatgccttggtccgaaaaattcgccaatttctacggccgtgtccctgaccaaggctttgatcagtttctaaaagatcaaaaattgatcaaataaaaattttcaagcaaaaaaaagcagaagcgctagcgcttctgctttttgcatttatcaagtcaattaagctttgatttcagttacaacgcctgaaccaacagtacgtccgccttcacgaattgagaaacgagttccgtcttcgatagcgattgggtggatcaattcaacgtcgattgttacgttatcgccaggcataaccatttcagttccttctggtaattcaacaacaccagttacgtcagttgtacggaagtagaactgaggacggtagttagtgaagaatggagtgtgacgtccaccttcttcttttgtcaaaacataaacttcagctttgaattttgtatgaggtgtgattgtaccagctttagccaatacttgtccacgttggatgtcttcacgagcaaccccacgtagcaatgcaccaatgttatcccctgcttcagcatagtctaacaatttacggaacatttcaacacctgttacagttgttttagcagtttcgtcagcaataccaacgatttctacttcatcaccaacgcgaacttgtccacgttcaacacggcctgtagcaacagtaccacgtccagtgattgagaatacgtcttcgactggcatcatgaatggtttgtcagtatcacgttctggagttggaacgtattcgtcaactgcagccatcaattccatgattttttcttcgtatgaaggatctccttcaagagctttcaaagcagaaccggcgattacaggaacatcgtcgcctgggaagtcatattcagacaataggtcacgaacttccatttcaactaattctagcaattcttcgtcatcaaccatatccattttgttcaagaaaacaacgatgtatggtacgccaacgttacgtgataacaagatgtgttcacgagtttgaggcataggaccgtcagcagcagatactactaagatcgcaccgtccatttgcgcagcaccagtgatcatgtttttaacatagtccgcgtgtcctgggcagtctacgtgagcgtagtggcgagcttcagtttcatactcaacgtgagcagttgagatagtgattccgcgttcgcgttcttctggagcaccatcgatttggtcgtaagcagaagcttgtgccaaaccttttttagataatacagttgtgatagcagctgtaagtgtagttttaccatggtcaacgtgtccgatcgtaccaatgtttacgtggggtttagaacggtcaaatttttcttttgccattttaaaatgttcctcctaaaaatacagtttattttttatatttgataggtagagggcgcgaagccccccatcccttatcatcgataatattgtacacgaaacttcataaaaaatatagctttttactgaatttcgcatttgtgcatcaattattcagctttgccgccgtttttcttgatgatttcttcttgaacagacttaggtacatcttcatagtgatcaaatgtcatcatgaaagtaccgcgtccttgagtagatgaacgaagtgttgttgcatatccgaacatttcagccaatggaacaatcgcgttaacgatttgtgagttaccatgcgcttccataccttcaacacgtccacgacgagcagttacgtgtcccataacatcacctaagtaatcttcaggaacagtgataacaactttcatcattggttcaagaatcactggattagctttcttcgctgcagcacgtaaagccattgaagctgccacacggaaggctgtttcacttgaatcgacatcatggtatgaaccatcgtaaagcttggctttgatgtcaaccaatggataaccagctagaacaccgttagccattgagtcttcaagtcctttttcaactgctgggatgtattcacgtggaaccacaccaccgacaattgcgttttcgaattcgaagcctttaccttcttcgtttggtgtaaattcgatccatacgtgaccgtattgacctttaccaccagactgacgtacaaatttaccttcggcttgcgtagaagcacggaatgtttcgcggtaagaaacttgaggcgcaccaacgtttgcttcaactttaaattcgcgacgcatacggtcaacaaggacgtccaagtgaagttcacccatccctgcgataacagtttcgccagtttcagcgtttgtttctacacggaatgaaggatcttcttcagcaagtttttgtaaagccacacccattttatcttggtcagcttttgatttaggttcaacagctacttcgataactggttctgggaattcgattgattcaaggataactggtgatttttcgtcacacaatgtatcccctgttgttgtatctttcaaaccaacagctgcagcgatatcgcctgaataaactgtttggatttctgcacgagtgttcgcgtgcatttgcaggatacgaccgatacgttcgcgtttgtcttttgaagcattcaagacatatgatccagagttcaagacacctgaatacacacggaagaatgtcaaacgacctacgaatgggtcagtcattactttaaatgctagtgaagcaaaaggcgcttcatcgtcagcaggacgatcagtttcttcgtcagttttaggattgatccctttgattgcaggaacatcaagtggtgaaggaaggtagtcgatgactgcatccaacatcaattgaacccctttgtttttgaaggctgaaccacaaagaactgggaaaaattcaacagtcaatgtcgcttgacggataccagctttcaattcttcttcagtgatttcttcaccttccaagaatttcatcattagctcttcgtcagtatctgcaacagcttcaactaatttttcgcgccattcttcagctaattctttgtactcttcaggaatttcagtttcttgaatctctgttcctaaatcgtttgtatagatctcagctttcatttttactagatcgatgataccagtaaagtcatcttccgcaccaattggtaattggattggatgagcatttgcttgcaagcgatcatgtaaagtagatacagagtataagaagtctgcaccgattttatccattttgttacagaatacgatacgtggtacgcggtaatctgtcgcttgacgccaaactgtttcagtttgtggttctacaccagattgtgagtccaatactgttacagcaccgtcaagaacccgtagtgaacgttgtacttcaattgtgaagtccacgtgtccaggagtgtcgatgatatttacgcggttttctttccattgcgcagttgtcgcagcagaagtgatcgtgatcccacgttcttgttcttgttccatccagtccatttgagaagcaccttcatgtgtttccccaattttatggattttacctgtgtaataaaggatacgttcagttgtcgttgttttaccagcgtcaacgtgggccatgatcccgatattacgagttttttctagcgaaaattctcttgccattctaggttgttcccctctcattcttacttaaacctaagctaaggttgtctcagtaccttccaataaaaagcagtgaggatcttaccaacgatagtgagcaaatgcgcggttggcttccgccattttgtgtgtgtcttcgcgtttcttcacagaagcaccagtgttgtttgctgcatccatgatttctttcgcaagacgttcttccattgtgtgttcgccacgcaaacgagcgtagtttaccacccaacgaagacctagagttgtacgacgttctggacgaacttcaactgggacttggtagttagaaccaccgacacggcgagctttaacttccaatacaggcataatgttcttcattgcttgttcgaaaacttccaatggatcatttcctgtagattctttgataatgccaaaagcattgtagataatatttgcagcaacaccgcgtttaccatcaaccattacacggttgatcaaacgagttactaattttgagttataaataggatctggtaaaacatcacgttttgcaacaggacctttacgaggcatccgtaactcctccttccgaaatatcagttctgattaaatagtttcatttgtagtttgaatcaaaattaagctttaggacgttttgttccatatttagaacgagattgtttacgatcgttaacaccggcagtatccaatgcaccacgaacgatatggtaacgtacccctggtaagtcttttacacgtccaccgcgtagcaataccacactgtgttcttgcaagttgtgaccgatacctggaatataagctgtcacttcaatcaagtttgacaaacgaacacgcgcatatttacgtagagctgagttcggttttttcggtgtcatagttcccacacgagtagctaccccacgcttttgaggtgagttaacattcgtttgagcttttttgaaactgttgtatcctttgttcaatgctggtgaatttgatttttcaaccttggatttacgaggtttacgtactaattgattaattgtaggcatccctagttttcctccttccttgattcgctttatagttccacacatccaggtggttctttttttgcgataaaaaataatgcattctctgcattcttatcaaatatgctttgataaacagtcagcacgtctccaacgagagacctgtagataaagcacctttgatagaataccatgataaaaagactctgtcaaccatctctccaatgattttttatgaaaggagtaactgccaaaattttataaaaaaactctcccttgcgcctcctttttacttcttcttactatataataaagatgaaaatagtattttattagaggtgggtcaataatgaatctaaaagagatggtcggtattgaagcggccagctatgtcactgacggtatggtcgtcggtttaggaactggttcaactgcgtattacatgatcgaagaattggggcgcagagtgaaagaagaaaacttgtcgatcgttggtgtaccaacatcctgggcatcaaaaaaacaagcagaatcgttagggatcccggtcaaaacgatcgatgaagtggcaagtgtcgatttaacgatcgatggtgcagatgagatcagcggagactatcatggaatcaaaggtggcggtgccgcactgctttttgaaaaaatcgtcgcaacctactctaaaaaagttctttggattgttgataaatcaaagatcgttgaaaaattaggcgcattcccattacctgtagaagtgattccctatggcagtcagcaattgatgcgattgtttacagaaaaaaactatcaccctgtccttcgcctagccgaagatggcaccccgctaaaaactgattgcggtcattacatcattgatcttcatctacaaaccatcaatgaaccagttgcattggctcatgaactagatcaaaccgtcggtgttgtagagcacgggctcttcttggatatggtccatacgatcatcattggacaagaagatggacctgagacccgcagcgttcgctgatgcctctagcaacaaaaggagcaagtgctccttttgttcgaggttctacgtatttttcttcatttttctagagttaaattcatttttgtgcaagttttctctatcatttatgcctcatttatgctacattcaaataaaaaagaataggaaggagcggctatgaaagtcatcggttatgctcgcacaacaattattgataaagaatcaagtgaacaattaaacaaactaaaagaatttggttgtacagaattgttccacgaaacctatgcctacgaagaaaactgtgataaccactcattagaatctgtgattgctcgtatgcagtctggggaaacgctggttgtttctgaacttcatcgtttaggtaaaacaacccggcaattaactgaattgacagatcttctaagaaaaagaaaccttcacctagtttctctagcagaaaacatcgatacgagagaacccatgggggcgatttatttcaatttaatggaaggtttggcagcgatggaacaagccttaatcaaagaacggacattagtcggattgaacaatgcccgaaagaacggcaaaattggcggacgtccaaaaatcgatccaaaaaccatcaaaaaaattcgccagctttattacaataaaaaagagacgattcaattcatctccacaaaatgcggtgtttctgtcggaacctgctataaatacataaaactttcagaagaagaattggataaagtatacagtcattaatcacttgtctgaatccggtgcttcatctttttttctgtgcgccgatcctgtcagacaaaatgattcagaaataaaaaagaacgtcttgaagaaagacgtttttttctgtttctttttttaagaaacaaggttttacgctaaatacgtagaaattctttgcgaaaaagtgtacaataaacagggaattgaaaatttcagaaaaatatctaatatctaaaaggagagttttacatgccaaaattagtattttctcgtcacggactaagcgaatggaataaattgaaccaatttactggttgggccgatgtagatttagcgccagaaggtgtcgaagaagcaatcgagggcggacgtaaaatcaaagaagccggcatcgaattcgatgttgcctacacatctgtattaactcgtgccatcaaaacttgtaactacattttagaatattctgatcaactatgggtgccaacaatcaaatcttggcgtttgaacgaacgtcactacggtaaactacaaggattgaacaaaaaagaaactgctgaaaaatacggagacgaacaagttcacatctggcgtcgttcctacgatgtattgcctccattgatggatgcatctgatgaaggttctgcagcaaacgatcgtcgttatgcaatgcttgatcctcgcgacgtacctggcggcgaaaacttgaaagtaacgctagaacgtgcattacctttctggcaagatgaaatcgcacctgcattgaaagacaacaaaactgttttagttgccgctcacggaaactctctacgtgcgttagcaaaacacatcgaaggtatctctgatgaagacatcatggatcttgaaattccaacaggtcaaccacttgtttatgaattgaacgatgatctaacagttgcgaaaaaatattacttataatcattaacagccaaggctgtgctgcaagtcagagcaagagtattcttcctgactgacggcacagtctttttttgattggtttcctgagaaatattcgttataattgaaaccgcatacgaaaggagcttggaatgatgaccacactctgtaaaaatgatacgctactatttcttggagatagcatcaccgactgcggccgtgatcgactcgatgctacggatctgggaaaaggattttccgcctttgtggcagcccatctagctgcagaatacccagatgcaaacttgtcatttgttaaccgcggcattagcgggaataaaattcgcgatatcttaaatcgcatcgaggaagactgcattgatttaaagccagatctactgattttcttgatcggtatcaatgatacctggcgcaatattggcacctcctctttcggcacacccgaagcaactgcgacatttgctagtgattatcggcaatttttgcagcaagtgaccgaaagtgggatcaagaaaatcctgcttttagagccatttgttcttccttatccagcagatcgcaaacaatggcggaaggatttggatcccaagatccattccattcgtgaactagctgctgaatttggttgtgactaccttcctttagacggcttattcgctgaacgtactgtcaaaaaacattcatcttattatactggggaagatggtgtacatccaacaatcgccggacatggtgtgatcgcacaagagatcttgcgccgtatccattattcaagataattctttgatagaagtacgcagacaaataatcggtaggataccaattaccctaccgattatttgtctattctgtcaggatttcttcatttagagatactctgaaggggtcaaagcctcttgataaatggcaatgacatcagattctgtcaacggtacgtaggcatttgtcgcaattgaactaaatgctactgcttgtttggccatttcttcaaaatgacgatcatcttcgatccccacttctggtaaagtcattgggatcccacaagcaaggaagaaatcgtataacttttgaatccccatccgagctgccatttctgggaccgcttcttctacttggaatacttcacgggcaaagcgagccaacttaggtgctgttgtctcattcaacacatgaagcatccagcggggcgtcaagatggctaagccgatcccatgagtaatatcataaaaagcactcaactcatgttccattggatggcacgaccacgcaccggctttcccactacctgtcaacccatttaacgccaatgtacttgcccacatcaagtttgcccgagcatcatagtcatctggggtatccaaaacaatcggcaagtttgtgattaccgctttcaacagcccttctgcgatgccgtcttgtacatccgtattctctgttgtactaaagtagttttcgatcagatgactcataatatctgcagaaccagccgctgtttgatagcgattgacgctaaaggtccaggtgggatctaagaaagaaaccttcggcaagaaattaggaccgtggacccctaatttttgtttcgctgtaaggttcgtgataactgctccccgattcatttcactaccagttgcagctaatgtcaaaaccgtaactaatggcaatgctggcccttggtagctgcgtttagtcactaaagtccaaggatcttcctcactgcaagcagcacctgcgatcactttgctgcaatcaatcacggagccgcctccgactgcaagaatcacatcaattttttcagtgcggcagagttctgccccttttgctactgtttcaatccgagggtttggttcaactcctgctaattctgttacttgattgtcattgttttgcaattgcgccatgacttgatcataaagtccgctttttttgatactgccgccgccatagaccaataggacattttttccgaaagtattcaatacttccggcaactcatttaaccgatctttcccaaaacgtatatccgttgtcacctgaaaagtaaaattattcatgctccaacctccttttctttaattaaaccattttcgtccaaaagtgcaactattccaactagctagaaagattcaatcaatcatttaacaaaaaatcactttctgactggctcccattgtctaaggagtcaatcagaaagcgatacaggaataaaaaattttttgtaggctgtaggataagaaaaaggattaggagatagctgtttctaagccaactttgatcatatcattgaatgttgtttgtctctcttccgctgttgtttcttctccagtgatgatatgatcactgactgtgcagatcgctaaggtctgtacgtggaattttgctcctaaatagtaaagcgcagcggcctccatctcaacacctaatacaccaagatcagccaattccactgtttctgccatatcatctttatagaaagtatcttccgataaaatgttcccaacgtgggtggtaaagccggatgcaatcgctgtatcatacgctttacgcaacaagtcgaaatctgcgattggcggaaaatgaaaactttgaaagttctttgctaccatggaagaacttgtcgctgcagcttgggcgatcactaagtcccgaacatgaacatctttagaaatcgcgccacaagtgccgacacgaatcaatttttttacgccataagaattgatcaattcatgggcataaatggtcgcagaaggcatccccataccagttccttgtactgatactcgctcacctttgtagacaccggtataaccgagcatccctcggacattgttataacagatcgggtcttctaaaaatgtttctgcaatgtattttgcgcgtagaggatcgccaggtaataaaatcttatcagcaatctcgccagcttttgcttcaatatgaacgctcatcttttcgctccttttctacttctcttttatgctctttttttagggtttgcttgttttacagattcgctaaagtttctttgatcagcgctttaaattcggctttgacccgttctgttgtctctacgacttcttcatggttcaggcttgcttgcataccagcagctagattggtgatacatgaaacgcccaacactttcaagccactatgaacagctacgattacctcaggaaccgtcgacatacccacagcatctgcaccgatcgtacgagcaaatcgaatttcagcaggtgtttcataagtcggcccagaaaagcccatgtaaactccttcttttaagtggagaccttttgtttctgcaatttgttttgctgtttcccggtagcttggatgataagcctggctcatatcagggaatcgtggtcccatttcttcttcgttagccccaatcaatggattgtcccccatgaaattgatttgatccgtgatcaacatcaaatcaccaggttggaaactttcattcactccgccgcatgcgttcgtcacaacaagtgaatgtgcttcaagggccgccattactcgaacagggtaagtaactgtctgcatggaatgtccttcatagtaatggaaacgaccttgcatcgccaatactttttttccagataatgtaccataaactagttgtccggcatgcccgacgactgttgaaactggaaaatgagggatatcgttataaggcagcacaattggattttcaatctcatctgctaattcacctaatcctgaacctaagatcaaaccaaaatcaatagatcctacccctttttccttgatgaatgtcgttgtttcctgcaatttctcatgtaatgttgtcatttctccacctctaatttaaatgatttaagaagctttccccattttctgttgccggtactgcaaagttttctgcaattgttgctgaaatatcggcataatggccttggggtagttggccttgtcctttaaattgtttgctgtaaaccaataatggtacatattctcttgtatgatcagtcccagtaaaggttggatcatttccgtgatcggctgtgatcattaataaatcatcgtcagccatggcatccagaatctctgggattcttaaatcgaaatcttcaatggcatgagcataaccgacaacatcccggcgatggccgtaaagcgcatcgaaatcaactaaattagtaaaacttaggccggtaaagtcttgcttcatcacattcaatagctgatccacaccatccatattgctctttgttcttactgaatcagtgattccttgaccattgaagatgtcattgatctttccgacagcgatgacgtctttgccagcatctttcaacgaatccaacactgtgtgtccaaaaggatccagtgcatagtcatgccggttgcttgtccgggtgaagtttcctggttcaccaacataagggcgagcaatgatgcggccgatcatatatggttcatctttggtaatatcacgcacatattggcaaatgcggtacaattcttccaacggaatgatttcttcatgagctgcaatttgcaagactggatcggcagacgtataaacgatcaaatcgcctgttttcatttggtgttcaccgtaatcatcaatgactgctgtaccggaataaggtttgttgcagacgattttacgtccagaaaattcttcgatttgttgcagcaattcttgaggaaatccgtcaggaaacacacgaaacggtttttgaatattcaaacccatgatttcccagtgtccagtcatggtatcttttccgacagagatttcttctagtttcgttgcatagccgtcatggtctgctacatttttgacaccatccagcggtcggatcgtaccaagacctaactgttccaaatgaggaatcgtcaatccagcttctttggcgatatgtcctaatgtatcagaaccaacgtcaccaaatttttctgcatcgggcgcttcaccgatacctacagaatccattacgatcaaatgtacacgtttaaacattcttttccctactttcttttattgttattcttttcttatcatactagaaataagaaagatttgcctttaaggatgtttgagatattgggtttcttgctgctacacaaaaaaaagggcagggcacagcaacacaaacatgtcccatagccccaccctttcatacagaaaaaattatttagatttgatgtagttcttaccgttagctttaggtcctgccgctttcccaaggaacagcactagaacaataattgttaacgcatatggtgctgcttgtagataaaccgctggaatggaggaaatgattggcaattgtccgccaacgatactgatgttttgcgcaaagccgaagaaaattgcagcgcccatcgcacctaacggattccatttaccaaagatcattgctgccattgagataaacccttgaccggcaatcgttgttacagcaaaacgtccagcgattgattgggcaaataacgcgccacccattccgcctaggaaaccggagatcaacacgccagaatagcgcatcacatagacattgattcctaaggtatctgctgcctgagggtgttcacccacggaacgtagccgtaagccaaatcgtgttttaaagatgacaaaccaagcaatcacagaaatcaagatcgcaaagtaagcaggtaaaaacgtttggttaaagaagactggaccaatcacaggaatatcacgcaacacaggaaaattgaaataccctaatgtttgttgaatattgtctgtttgccctttgttgtagatggctttaactaagaagacagccagcgctggcgccatcaaattcattacggtaccactgataatgtgatctgctctaaagttgatggtggctacagcatgcagcagtgagaaggccattcctactaacccgccgactagcattcctaaccaaggtgtccatgcaccaaattgtgacgcaaattcaatattgaaaacgatcgaactgaaggcacccatcaccatgattccttcaagacctacgttaacgatcccgcttcgctctgagaaaacgccgcccagtgcagtcaggatcaatggtgcagcataaatcaacgtttgtgtgacgatcgaagaaattaaactgatattcattagatggttcctccttcctgatcttgattatttggctttgcttcaatttcttggacaacagcgacttcctttttgccatcaaagattttagctaatacaaaacgaatcacgtagctgatcgcaacgaagaagatgatgatcgcaatgtcgacatcaacaagttctgaaggaatccctgcaaactgcattccttgtccgcccagtttaagaacactgaacagcaatgcagaaagtaaaatcccaatcgaagacccgctgcctaataatgagactgccatcccatcaaaaccaatactcaatgacgaaccttgaacgaagaagttttcaaaagttcccaaaccttgaacgacgccacctaatccagctaatgttccagagatgatcattgaaataatgattgtccgtttgctgctcatcccagcatactcagatgcggttggattcaaaccaactgctcgaatctcataacctaacgttgttttcttcatcatgaaccaaatcaacacgaggaagatcagtgccatgaaaataccaatgtttaaccgggaattgttggtcaaatttgctaagaaaggtgtttgtaaagaggcattgtcgcctaccattttggtcacaccttttgttgtgatcatggattcattcatgacgttattgacgatatgatttcctgtatacaataaaatataattcatcataatagttacgataacttcactcgtaccaaagaaggcacgtaagatacctggaatagctgcagcaattgcaccacaggctgcccctacaagaatagcggtaggcaacacgatgattcgaggagcatctggcatagacaatgcgacccagatacttgctacccatcctgctaatgcttgtccagaaagaccgatattaaagaatcctgcagaattcgctactgcgaatcccaaagctgtaaaaatcagtggaccagctgtaacgaaaatctcaccaatatttctagcattcaatccgccgttttgaccattgataaatacggtacggaacatttgaagatacccatcgattgggctgtagccaaatgccgccatgatgattccaccaaggataaaaccaagcagaacagcaatgatcggcacaagcaggttccgaattttttctttgcggttattcaacagaaccacctacttcctccatttgtagctcgcgtcgggcttcttctaatgaataacccgccattagtaatccgagttctttttctgatgtctctttcggatcaacgacgccaacaatctcaccagcatggataacggcgattcggtctgatacgttcaaaatctcatctaattcgaagctgactaacaagacagctttgaatttgtcccgctgttcgatcaaacgtttatggataaactcaattgcgcctacgtctaagccccgtgttgggttcgctacgatcaaaagatccggatcacggctgatttcccgtgcaataatcgccttttgctgattcccgccagagagggcacgagcaggaacaatctcattgactgtacggacatcaaactcttggatcaatccacgggcaaattcattcatttccccgtagtccagcacgccataattgctcagcggtttttgataatacgtttgtaaagcaatgttttctgaaagcatcatgtctagaaccaatccatatttatgacggtcttccggcacatgcccgacacctgcctccgttactttacgaggtttgaaatttgtaatgtcgtcaccattcaataagactttgccgctttcggattttcttaatcctgtgattgcctgtagcaattccgactgtccgttgccatcgattccggcaatccccagaacttccccagcccgcacttccaaacttaagcctttaacagcctctaggccgcgattttcttttacaactaagttttcgatagacaggacgacttcttttggttctgcaggttttttcggtgttttgaaggaaacagaacgaccaaccatcatatctgccaattgctgtgacgttacgtctttgacattgactgtacctattcctttgcctcggcgaatcactgtacaacggtccgctactgctttgatttcatccaacttatgagtaatcaaaatgatggattttccttcccgaacaagtcctctcataatgacaatcaattcttcgatttcttgtggtgtcagtactgcagttggttcatcaaaaatcagtacatctgcaccccggtataatgtttttagaatctccacacgctgttccatcccgactgagatgtctcgcacataagcatctgggtcaaccgataagccatattgctcagaaacccgtttgatttctttgcgggcttttttacggtccaacacacccaatttatttggttcgcttcctaaaatgatattttccgtgacagtaaacgcgtcaaccagcataaaatgctgatggaccataccaatgccaagtttattagctgctgtagggctagtaatattcactttctccccattcatcaagatatcgcctgatgtcggttctaacaaacctgacagcatattcatcaaggtcgacttgccagctccgttttccccaagcaatgcgtggatttctcccggccttacttgtaagttgacatcgtcattggctttgaaggttccaaactctttggtgatatggcgcatttctacaacatatttttcttcagccaagtttctcacatccttactttctaattcgctctcacactcagtgacacaacaatttttaatacaaataaatgctattgcttaggatggttattatcctcatgaaaactcaacagctttcatcaagacattaaccactaaagatgtattagcaagacgagcatctgaacgatagtgaatcgctcaactctactatcgttcagaatttcttgtctttttttttcattgtttaaaaaaacttgcttatttttctggtttttctggcacttcaactttgccatcgatcacatcttgttttgctgtttcgatcgctgcttttgcatcatctgataagaaaccttcagtgatatctacaccgccgtctttcaaaccataaacgatgtgttcgccgccagggaagttatcttctaatgcacgtgttgaaatatcttgtacggctgcgcctacacctttaagtgttgaagccaatgtgaagttgtcttctttgccgtcttttgttttgtatgcaccttcgtcttgttggtcgctatctacaccgataacccaaacttttttgtctgcaaggtcagcttcgttcaattgttcattgattgcttttgcttcttggaagacaccagcaccagtaccacctgaagcatggaagattacgtcaacgccgccttggtacattgaagctgctagggctttcccttttgcagggtcaccaaatgatgctgcatattgagaatcaattttaatctctttgcctaatgctttagaagcatcttcgacacctttgataaaaccagcttcaaaacggtcgattacgacaccttcttcaccgccgataaagccaactttgtttgtttttgttgtataagctgctgcaaaaccagctaagtaagctgcttcgttgtctttgaaggttgcagaaacaacattgtctttgccttcgatgacatcatcgataatcccaaattgagtatcagggttttgtgctgcagctgcttcaattgaatctttcaataggtaaccgacaccaaaaatcgttttgaatccgttttggacagcaccatttacgtttgttgtatattctgaagcttcatttgattgaacgtagtcatatccaccaacaccgcgagcgatgttatgttctttcccccaagcttccaaaccttcccaagcagattggttgaatgaacggtcatctacaccaccgatatcggtaacgattgctacactgtgtgctgcatctgttttgccgtctgcagaaccgccgcctgttgaatcagtcgaacctgactttcctccattgccacatgcaccaagtagtgtcaacccagccactgcaacaattcctaaactaaataattttgcttttttcattgctgtaaagccccctataaaatagtttttatttttcaacagccgcttcgactgaatgaacatggtttatagatctttgttcgtaaaataatatggcagcaacccttcgacagttgtctctttgattataccatcgtctcccacaagagtgactggcatatccggctgacagaactcaaccattacttggcggcaggcgccacaaggtgagataggctctggcgtatgaccagcaacaactaagtgttgaaagtctttttcgccttctgaaattgctttgaaaaatgcggtgcgttccgcgcaattcgttaagccaaacgaagcattttcgatattgatgccttgatagatggttccttttttggtgaccaagcaggccccaactggaaatttagaataaggaacgtaagctttgtctaatgcggcaactgccgtttcgatccactcttttttcgcttttgtcatgatgaacctcactttattgaattagtagccagcccccgttgaccctgtaacgattgctacacttgcactggttcctaaacgatttgctcctgcttcgaccattgctgctgcttctgcttcgttatggatgccgccagatgctttcacacccatttcagggcccactgtttcacgcatcagtttgacatcagcaacaaccgctccgccagtagagaatcctgtcgatgttttgacaaaatcagctcctgctgctttcgctaattcacaggcctttacgatttcttcattgtctaaaagtgctgtttcaataatgactttcactaatgctttgtctttagctgctgcaacaaccgcttcgatatccgcttgaacttttttgaactgttttgatttcaaggcaccaatattaatgaccatatccacttcatcggcaccattcttgatggcatctgccgtttcataagctttgacttctgatgtattggcacctaaaggaaagccgatcacggtacaaacagccgtcggttcaccttttaattcttctgctgccaaagctacccaagtaggattgatacagacagaataaaagtgataggtttttgcctcttcaatgatgcgcaagacatcttcttttgttgcatctgcctttaaaatagtgtggtcgatcatgcgatttaattccattccactcgctccttattctgtaatgatttcatggatcaacggtggctcaccgccgctttctccgatttcaatattttgatagatcaattcgatgacatcatcgatggcttctgtgttgctgtagatcgttaacagtgcttcaccttgctcaacagactctcccacttttttatgcagtttgattcctactgcgtgatcgatgtcttcttctttggttttgcggccggcacctaacatcatagctgcgatgcctagttcattggcaacgatcttagttacgacgccagaagtttttgctggtaatgctctttgataattggcagtcaagatttggcttggatcatcgatcactgaatcatcgccaccttgattacggatcatttcacgaaatttagccaacgctttaccagagtgcagtgcctcttccaataatgcgcgtgcttcttccaacgattctgctttttgggctaaaacaaccatttggctgcctaatgcatagcacatttcttctaaatcagctggaccgtttccttgcaatgtttcaatagcttccactacttccaaactatttccaatggcttcgcctaatggctgtgacatatctgagatcacagccattgtctgacggttcgctaatttgccaatccgaaccatcgtttgtgctaagcgtttggcatcctcaattttcttcatgaaagcaccgtcaccagtcgtcacatctaacacgatggcatccgcacctgctgcgattttcttactcatgatcgagctagcgatcaatggaatcgagcttacggtcgctgtgacatcccgcaacgcatataattttttgtctgcagggtccaaatcccccgactgaccgataaccgccactttgctttcgtttacgaggcgaataaactcttcttctgcaatctcaatctgaaacccgggaattgattctaatttatccagcgtaccgcctgtgtaaccaagtccacgaccagacatcttggcaactggcacaccaacacttgctactagtggtgctagaatcaacgtggtagtatcaccgacaccccctgttgaatgtttatctactttgatgccttcgattgaagaaagatcaatgacttcaccagaatttgccatagctaaagttaggtttgtgatttcttcatcggacatatccacataaaaaatagccatcaacaaagcactcatctgataatctggaatacttccttcagtatacgcagttacaatgtagtcgatctcttcctttgtcaatgacttaccgtcacgctttttttcaattaaatccaccattcgcatcaaaatgaccctcgcttcctctgacattatacaatatttttcttgtaggtaaaccactttagtaaaacggtttactatataaaacaaaactatgaaaacacttacaattggaaatataccgcactatttcgcaattgtcaatgccttcacgctctcacgaagaattaattttgtatcaaaaatcttatttggaattcttcgagaaggaaactcgatggcgtctaccaaaaatttcgctgccgtaaagccaatctcaaaggttggctgcatcaccgtggtcaatggtggtgtgatgtattccgttagcttcaatgcgtcaaaaccaatcacagaaatatcctcgggcacttttttccctgcttcatagattgcttgataacagccgatcgccatagcatcattcccacaaaaaatagccgtaagctcgcggtatttcaataatttcttgcaggcatcgtatccgccggtcactgttaactcagccgactccacgtaacgccctttaaacgggatctgatgatctttcaacgcatgacgataaccattgaaacgttcttccaattgataataaccagtactttcttttagcataccgatgttttgatggccattattgatcagatagctgactgcttgataagcgccttcgtattctttcacaatcaaacggccattgtctctttgattgattccccgatcgacgagaataattggtcggtcatcaaaaaaaccgctcttcaatgaatactcgtcaggcagctgatgcggtgttgccaaaagaataccatccactgatcgatgagacagctctctcaaatattgtatttctttttcttggctatgtcgggagttacacaataccagcatataccccaatggattgaaatagctttctgctccttcaatgattttagaaaagaaaaaatccgtaacgtcaggaacaatcataccgatcgtttttgagtggcgattgattagattcgaagcaaaaaaatctggcttataatggtgcttattaacgatatccagtacccgtttgcgggtttcttcactgaaacggctacctttattgttcagaatttgcgaaacagtagttacagatacccctgccatttcagcaatctgcttgattgtcagtttcatttacttctcacctctttcttgcctaaagtgtagcaaattttttctaaaaaaaatagcaccccttgctttcttccaaaattttctttttacaagggttaaaaaacagctccattccttaaaaaaatcgacaaaagaaaacaaaaaataaaagaccagcgattctaggcagctccttgtagtgaccccaaaaagttagacttttatggagtggagaaatccactccttttttgtatgataagattaactgttagacagctgtttttacagcttctcgaaactgaaccggacttcgccaatttaatttctttttgatgcgtttatggttgtaataatagatatattggtcaatttttgttttcaattcatctaaactccgatagacttctccgtgaaaaatctcttgctttaataaaccaaagaagttttccataggtgagttatctaaacaattccctttacgagacatactctggaagattttatgctgcttcaatttattcttataagcattcatttgataggcccatccttgatctgaatggaaggttctacgaaatggacaatcatttgtcatctggattgcttcttctaatccttccattatggctagtgcgtttggtttttcagaaatccgataagatagaatttcactattgtagaaatccatgaaaggatctaaatacagctttttctgacgaacgacacctgtggtgtctacttcataatacttaaactctgtggtatcagttgtaattttttggtgacagatatttgtataaaaccgacgatgaatacgatttttggcgacagtgccaaccttcccacgataagaattgtaccgtcgagattttcgagtgtaagactttacttcgatacctagtttttttatcagacgttgaatcttctttttattgacatgaatcccttgattctctaattctttttttagtcgcagacagccgtaatctttatgatctttgcgaatttcaagcattttttcttcaatttcttggtctgggtttggtctgtcaaaccgtttctgccaatacatataggttgctttaggaaatttcaatgtttcaagaagctcaactagtttgaatgatcctcggaggctggcgatgattcgtgcgattgattcttgcgtctttgctgggcttcctgttttcgcagcttcctcaactcttttaaaaaggcattctcaatttgaagggatcggacttgcttttctaatgccttgatacgatcgcgttcttcagttgttgtattttcttttttgttttctttttttctagtcaaagtaagtggtcgccctttctcttttgagagcccctcaatacctgcttctctgaaattacgcatccaattggcaataagcgcagggttgttcatttctaaagtgctagcaacttctcgataggacatctcacttgtttgatataactctagcgtatttaacttaaattgaacagaatatttctgattttgatgctttctcaatagaccttcctctccgtattcacgatagacattcacccaattacttacttgagacttgcttgaaataccgtatttgttggcaagataccgatatccgcccacgccactaagatattctttaacgatttttagttttaattcaaaaggatattttgccatacaaataacgacccccaaaagttagattttttggtctaacttttgggggtcgcttcacctagcaaatgatcgtggtctttaaaaaacaggtaaacctattgtgaacgtgaaaaacgtctgctttgcgcgcttattctttgtagctttgaataatataataccctttgtcttttttgatgatttcggcattaccaaaggtttgttgcattttcttttgggcactgggggcaccttgtttcttttgaatcacgatcgttaatgtgccgcccgttttcaatagcggcagagcccctgtcaagatctcatgaacaacctctttgcctgcccgaataggtggattgctaagaattgctgcgtattcgccttgatgcaaggtttcgtaaatgtttgaggcatgaatgtcggcattctcgatgccatttcgtttcgcattgccttgggcaagatcaaccgcccgctggttgatatcgatcatttccactggacgctgggatgcataagccaatgacaacccgatcggtccatagccacaccccacatccaaaatcgttccctctggtaaatccgcccattcaaaggcatcaatcagtacgcgagagccataatcgacggtctcccgggaaaataccccactatctgtcacaaactgaaatttctttccttttaactcaaaagaccattgttcaaaatcatgtgcggtatccggattctctgtataataatgatttcccatctttgctcacccttttttcttttaactagcgatagttctcgctttatctgtttgacaatcaaaagcatttcatttgctgactcttttccatgatacccaaattcctgcagaagtaaactcccgataatcgtttcctcaatgaatcttagataattttcgtttctttgccaacgatttttcctattttttataagttcctgccatttctatggtaaaatatttccgagcagcaaccagatacagaaaatcagccttttctgaaggccaagtaccggtctgcaaagatagacaggttctatatgaaggagtcgaacatgcaagaaaccatgaatttttatcaaattcctcgggagcaatggcaaggcttttacaccaatggcatgatgcctttcactcaagaagaattagacaatatcaaaagtttgaatgaccgcatctcggtccaagatgtcgaagatgtttacgtgccactgtgccatctgatccacctttatatgaaagaatttgaatctctcacgttaagtaaaggacttttcttgcatcgttatgtcaaaatgccgccattcattattggcattgccggcagtgtcgctgttggtaaaagcacaacggcgcgtttggttcaaaacctgttgagccggcttttccctcggcgcaccgtgcaactgattactactgatggctttttgtacccaaacgaggtcctagaagcacgagggatcttggatcgaaaaggattccctgaaagttatgacatggaagcattgatcaattttttgaacgcggtgaagtctggagaatctgaaatcaagatccccgtttactctcatgaagtttataatattattccggatacgtttgaaatcatcaatcagccagatattttgatcgttgaaggaatcaatacattacagctgcccgcaaaccagcagatttatgtcagtgatttcttcgacttttcgattttcgtggatgcgcagcccgatctgatcgaaaagtggtatttagagcgttttgaatctcttttggatacggcttttcaaaaaccaaacaattattactatcagtatgcgattggcgaccgcggtgaagcaatcaaaatggcaaaagaagtatggaaaaatgtgaatttaaagaatttacacgagtatatcttgcctacacgcagcagagccgatataattctccataaaacaaagcaccattcaatcgatgaagtattcttgcgaaaatattgactgcttcattattcacccttatgctgttgaaaaggaatcttccttttttcaataaaactaaaagaatagaggtaatttattgtgacaaacgttgacaacatgccaaacgttgaaaaaattatcgtactcgattacggtagtcagtacaatcaactgatcacccgacgtattcgtgagttcggtgttttctcagagttattgagccaccgcattactgctgaagaagtaaaggcaatgaatcctaaagggatcatcctttctggcggtccaaacagtgtgtatgatgagaaggcatttggtattgatgaaaagatttttgatttggggatccccgtgttaggaatctgttacggtatgcagttgattacttataaattaggcggaaaagttgaaccagccaaaaaccgcgaatacggtaaagcagaattggaagtcacttctgccgatgctgctcttttccaaaatacacctgtgaaacaaacagtttggatgagtcatggcgatttagttacccaagcgccagcaggttttgacgtcattgccaccagcaaagactgtccaattgcttctatccaacatgcagagcgcaaaatgtatggtatccaattccatgccgaagtccgtcattccgaatatggcaatgatttgttgcgtcactttgcaatcgatgtttgccaatgtacaggcgactggacaatggacaacttcattgatatggagatcgctaagatccgcgaacaagtgggtgataagaaagtcttattaggtctatccggcggtgttgattcttctgtcgttggtgttctcttacaaaaagcgattggtgaccaattaacgtgtatctttgttgatcatggtctattgcgtaaaggagaagccgaacaagtcatggaaagtcttggcggaaaattcggcttgaatattatcaaagttgatgccaaagagcgtttcctatccaaattggctggtgtttctgatccagaagaaaaacgcaagatcattgggaatgaattcgtttatgtctttgatgacgaagcaaccaagctggccggtgaagaaggcgtgtctttccttgcacaagggaccctttataccgatgtgatcgaatcaggaacagaaacagcacaaacgatcaaatctcaccacaacgtaggcggtctgcctgaagatatgcaattcaaattgatcgaaccattgaacacattgttcaaagacgaagttcgtgaattaggaacccaattaggcatgcccgacagcatcgtatggcgtcaaccattcccaggaccaggtctaggtatccgtgttcttggcgaattgactgaagaaaaattagagatcgtccgtgattcagatgccatcttgcgagaagaaatcgccaatgctggattggatcgcgacatttggcaatacttcactgtcctaccaggtatccgctctgtaggtgtaatgggtgatggccgtacgtacgattacactgttggtatccgtgcagtcacttccatcgatggcatgaccgctgactttgcccgcatcccatgggaagtcttacaaaaaatcagcgtccgtatcgtgaacgaagtcgcacacgtcaatcgaatcgtgtatgatattacgagtaagccacctgcaactgtggagtgggaataagagaaaagagcttagaatcctttatttatagggagtctaggctctattttttgaagttatgcaaccattttgcaaccattagcttttattcttcttctgagttagaatcattaaaatcatttttcatttttctacataatttaagccccttaacttttctttgtgtaagttctaaagaatcataactttctctacatccgaaattattttgctcatatttaccaacttcatttaaggctaactgaaaagctttacataatgtttcatataaatcatttccatcagcataaacagacataacttgcatattcaattctttaaactcatctggtatattttcgccaaatctttcaatttttatagacacttgattttcccgcatacaaaaacctcctaattatattctaaagatattttctattcaaaaagatttctttatcatcaatagacattgaccatttttaaaatctaatataacgccatataacttagtagtactaagattttttttcaaatatttcgttcaacttgttaatcacttcatcactttgccaatccagtttaattggtataagtgcgccattatcataaagtaaaatttctccactaccagtttctttgaaaaatggtctttctttgattgggataactgtaaatgtatcaattcccacaagttcaaattgtcttttacggacggttgtgattttcgtttgcggtgtatgccctacaatttgtttttgatactttggatttggcaaaaagcttaattcatggtcaaaatcagcccataatggactacctaaaaagtatttcccacctcttgctttgccgacatgatcttctaaatcatctaaattgtcgattaaattttcagttattttttcaaaatgccaatcttctaaatcaaagtcttgggtgtaaccagcatgactaatcaaataatcatctaactgaaaagcaatttgcagatttaacttcaacagctttcgaccaactgaaagaaatccatctgcactttgcagtgaataccttctaggtgtcaccgtcaaataagacacgtcatgatttcctaaaagatttatcacttcgacaccgaaaactttcatctttgatttccatatgaacaaataatctaattcattcatgtaaagatcaacgtttttttcttgctcgtatgcgtctgtataatctcctagcaaaatcacttgtttaatgcctaattctttaactttctgctcaaccattggcaagattatttgtgctgttaagtgtaaatcgcccactaaaagtgttctcattttgaatcactctccctctaactctaatattttaaacgccttttgatatttcttaactctttcaaagtctttttcagttggggtagtaattcttgaaagattcatattatcttttaagtctgcaagttttaccatggtggctagtttatttttcttaatttctacaatatagtcaaaatagggttgataacgttcctgtgtcaaaacctgtactgccgaaacaatcgtgtctgaaaaacctaactctttcagtttttcaatagtaatatccgtgtcttcaacagtatcatgaagataggcaacaaccttagcatttttatctgttagtgaatttgccactcgttgaacatgaaaaaagtaaggttcaccacctttgtcagtttgaccagcgtgagcttttttcgctacctcgatagccatatttttaaatttatcatattctgtcatgttggcaatcctgactttcttttaaaattttggtctgaatgtcattgaggaaatttatttcttgctgagaataatctttctcaaatccgacaattgaaaaatgggtaacattcttgagtaaagctgaaacgacacaatcaaaagaatgtgcatggtctcgccgtacatctccggctattaaggtattaaaactataatgtaacccgtcctcaataaattccgataaaacataatacatatcgccaaattcaacacgattacctgtatcaacagcccaaacaccagatttagaatcatatttcggtattttttgccctttaaatttgtctgaatcaaaaacagtattttccatattgatacacctcgtcattctttatgcttcacatactgattgcctgtaagtttccgttgcgcattttccttaggcatttcaatagtattcgttaattttttagcgacttctttgttagcgttctggtataaatgtccgtaagttcccaaagttgtttgaatatcttcatgacctaagcgatcacgaacgaccaacgcattttcacccattgaaatcagcaatgaggcatgagaatgtctaagggcatgagccttgattctatgaatgccagctaatttcgaatgctgggtgataacgtggtaagtagcactcttatttgttggcagtccattgtaagacaacacgtattttgacggcacattttttgtttgaacggctttccagtctttcaatagtcttattgtatcatcatctaaggcgataactcgattactagcctttgtttttggttcagttacataaaattcgttcgcatttttataatacatagatttgtttacatgtaacgtttgattttcaaagtcaatatcattatcccattctagcgcttgtgcctctccaaaacgcaaaccagtcataaagagcaaccaaatcagcataaaagcaaaatgttcatgatagtccgataggtcaaatgttgcaattaccttttcaaattcttcttttgtccaaaaatccactcttttcttcacctttttcacgttgccaacttgtttagcaacattcttatttactaaccccaaagtaacagctaaatctaacgacatttgaaacagtccataaatattacggatataagcagatgaatagctttcagatagtttgttttgccatttcttgatgattggtggtgtaatgtcttttaacttgcgattagagaagtaggcgaaatgaatgtccatggaggacacccgattttcataggttcttggtttaacagaacgtttgtaatcaggtttaaaatacgtttcataaaattccttgtaagacatggtgctattctttttgattgcggaatcagaaaaatcgttcatgtaatcatcatagccacgttttgcctcacgttgtgtattatagccacgcccccagtgacgaatacgtttgcctttctcatcataaccgaggttagcgacaaagtaccatttgccacttttcttgtcttgataaatattagaaattttcggcataatcgcgtacctcattgacaataatttcaaaacctaaaatctcttcaacggctgaaataggcacacgtcccaaacgtttactggcataataagagtatcccttattcaccattaaacattttgcttttcgaataatatcagaggattggctcggtccaaatcctaatgcagacaattctttttttgttacagtgttattagtcaaacgaatcactcctttaaaatttttgtgtaacgcactgttccagttttaaaaacagaatgttgtccgtcaaactctttaaaatcaagaatttttcgtttatactcctttgagtaaacaattttttcattagaaaaattaaacagttgtgatgtggtagtttttctaatacgaggcgtttttaagttttgcgatttaaaaaacgcctttttcttatgttcttttaattcaaggtctttagcaaaatatttgctaagataacgcccacgattttccttgctatcaacatcaaccttgttaatcttgacatgaccgtttcgccaaatttttgtaagttctgaatttttaatataaccaagtgagaagaaaactacatggtagtgaattgcgcctcgtttctgtttttcccatgtagcaagatactttgctttctgatttctttttttcaatcgtctatttagtcgttgaataaattttttaaattcattatttgagaactcaatatcttgaacattgtcacgaaatgttaatgtgacaaattttgttgcttcatcaaaattacaatccacgattctagcaatttcccaacgcatgtcttcataatgttgttgttttcgctttaagctatcatatttctcattagttggtagctcatcataagttcgacgtgtattatcatcaattaaccaatctaattgacgtgaaccattttcattttcaacagactgactatagaaaataggttcatcatactgatacacctcaatgtaggtggaagtttcaataattttagtattatacgcacgagtttctttagacatcacacacctctcagcgcgcgctcaaacgagcagatgttgttttatatatcaagttaagtgtcgggcaaagaccgcccgactggccccctcaaagtgagtgaaaagactcggacactccgtttagtcgctggggcgactacctccctatttcactcacttcgagggggataatttgttgtaggctgataatcttttctaattcggctatgaaatcaaagtctttcatgaatggtgtttcaaagtatttttcttcgccttgtccgtcaatcttgatatatccgccacctttaacagaaattgtcttatgttctacgctagatgagccgaaacacattatatttgcctctttactggctgaacctaatagcgtacggcaaccaagctggtcacgtaaagcaccgtctaaaatggaactgtctggacgttgaagaataatttccacgaaacaacccattgcacgcccttttaaaatcaacgaatataagtaagccatgcattccgcacttaacttcttatccgcactcttgataaatgctgcaaattcatcaaacacgagtacaacaggcggtaaatcgaaatctacaaaggttttaccaaacgcagaaacttcactgaaatattgtctatatctcgtttccatgatttccgttacttttcttaatactcttgctatatggttcggctcactgacaactctatcttcaaagccatgaatgtatttcaataacgataaatccgccgacttcggatcggctacataaataattgcgcccatttgtgcataagctaaaattttgtattcaatccaaaccgattttccgctccctgtattgccaattgtcaaaccatgacttaccttgctgacatcataagagattttttcagtaacttgtatctttgtgccatttgctttaggaacgccatgagagaggtataagcgattatcgggtattttctcaaagatatagtcgcagtattgaatatcgtccataacggagcaactagcgccaaataaagcggatagttttgtctcacaagtattggcaaggtcattccattggtcaccatttttcaaaaagcgaatcacaagtttttcgggtgtatttagatagagtaggtacacgctatcaatgacgacgtttttcttcctatcatttccattgttatcttgaccgattatgcggtagccactttcaaataggttgttatccatgatgaaccgccttaacaacttatagggggaagtcacccacccccgttttcgattgattacgaatttataagttgtgtaaatcagcaagcaaaacaaaccgataagcacgagaatgaacaagaatccattttgaatatgactttctagccaaatcacacttcccatttcagcaaaaagtacgaatagtaatgaattccaccgatatttcagcggtacactaggtgagaatgccgaaactttttgaaatttgttttgtttgtttttcataggttacgccttaactaatacgcatttgtcagctttagaagataattgaatccaaccatttgaaacatacggattgaaagacagattttcaaacttcacataagtttcatctggaatttcatcattatcagtgtcaaataacggacgaggctcttcaattttgacagtgattttttcaaatttcttttcaagacaaacaacagtgtaattgtagtgtgtgattttatccgtcttttcaaattcaccactagaattttttacacgttcataagcgggtttcaaatccacaagaagaagtgacttgccagcggttgcgattggatcgataattggtttaattgccatttcaggtatttcctttcatgtttaacgttataagtgacggtgagtagataatgcaatagggcgaacccctattaagaatggtcatcatgttagtagcctcgtaatttatcccagattgattgtaaccagccgtaaagactttgaagtttcatttttgttagaaagaacatagagataaataatgatagggaacagactactgctagtaaaccgaacattaagccagttacttttgttgtggctagtcctagcccaagtccaagggctaagaagaagtagaaacgaaaattatcatagttcatttttttcaatcctttcaatttttgataatgctttgagtatgcctttttcagcgtattcacgttgtagtgtgtctaattgcaagtaatatttgatttcttgtagaataatgtttgctttttctgaattggtcatgatagcctcttcaaattattttataaagtgttaccacatatacacaatgtttagttaaaaaattctaaatagcggttaaactatttagaaaaaaattttagtcctctaatcgactataaaaggcgaagacaactagcttgatgatataactcaatcttgggagacgtttgccaggttcatcacttttaaagtgataacgatattcttctaatccctctaagacattctcatctaaaaatattctaggggtaacggtatcctcattttgaaaattttctttaacggccgttctgtccatgcgattttgaattttttcccattcatcatcagtgaaatttcgttttttacagaatctatatgcctgttctatcacactaccagccgatacttttaacactacgttaaatgagataccgtcaagtaaatcaccgtaatgttcttgcatatctgtttctagtttgtccgttagaccgttttttatttcttcttttaattcacgttctctacgcaaaattaattgatctatccaaattttcgcctcataagctagacgaatagttttatatactcttgccatgattaatcagtcccctataaaatgatttcagtcgtaaatattgcatggtctggatagggaggttcattaataatgaaatatccttctggaaccatatatccttcaaggtatgatgaattattatttttcccaaaactccaatcaagttgattatatttagaattataatcaattgatacccctttgctaatcatccagtctaatcgtttccatttccaacttgttccaaaaggtgaatacggagaatattggttacagtttaggtatttttcatctctcatcatataaataatatcttgccaatttagttcttcctttttgcaccaatcgacctccgagggactatagtttaaatcgccaataataatttgattattgaaatgtttgttttcttttagtaaccaattgatttgagattttctactgatcaattcatcttttcttttttttgagccaactcttattctcgtaccaataatcgttaattcttgcccagtttttattgagctttttattttaagccaattgggttgattattttcaaaatcttcttcccaagatacatcttccagagaagactcattaaatatacttttctttaaagcgatataaatcccgttgcctcttttaacatcattcttattattggtatactttgaaccgttataagaatatgtaaaataatcttcagaaaaagagttatctaatctaaacttattttcttttcctttaaattcaactaacactataacgtctggatttttttgagaaatttccgagataacataattgggaaatttgctatcttcactagaacgttgattaatattccattcaagtatttttatatttgtcattattattaccttacttccttaatttatcgaccatttaaagcataaacaaaagctaaataatttgcaaaatcaccaattcttttgcgtactgattgcaagtcatctttatttctagtaggattatcactttgaagaaataatttttccgtccatgttttactatcccaatcattcattttaaaaatacgttctaaaacaatgaagttgttaatcacaaggtcatgtgctgaagttcgagaattgtctttctccattttttcgtttttagtcattaaattccactttgcacgaatagaggaataagcaatcacagaacgaatagtttcttcccaaaattctttgaaatcttcattttttgtgtcggcattagataaaacttgttcgtgaatgtcttccatttcttcaaagctcaatggttcgagtggcgaagctagataattgctaaaagtgatttgttcaaattccatgagttgcctcctctgcttatctaaaaagtgtttttagtgttaacacaaatataatatcatgtttgaaataattttcaagtgatttgttcaatttttttttatttgcaacctctttgcaaccaatacagaaaaaacgttacgatttctaccattttcaaacaacacaaaaccgtataaactcaacaaattaatccttacaaaacgttaaccgcatggagtgggaataataaaagaaaccgtgaatcctttgatactaagggattcacggttcttttttgcttttgaagttcttttactgaagaaaagatactatagagaaacagttatcatatcatcgtctgagattagtcgtattactttacatgttcaacttctgctttttaaataaaaattaattttgtatactattcttaataaaatgaaagaaaatcaaaagagctaatatgttttttagcaattttcagaagaaaggagggttcttttgagcaaaacgataaatctgactccgcccataaggcaaagcttcaccatcttcatcaaagtagtaaataaaatcttgcgcaaataaagtagcccgctcaataaatcgctctgaccattctggatcttcttctttcataaaagtagcatagatcaaaccgtaataatgaaaggcaaaagcaacataataatcgcgttgcgttacttttccatctacgtaccatccatcaccaatatacatcgaatcgatcaacgctaattcttgtgtaagttcgttttttgccaatggatccccacactgatacaatgccacccggatcaacactttaaagaatgtccaattgtttttgggaatcttacaggttaatgcgtgtgacaaccactttttcagtgcttgttgattcctttcaggcaattgctcccaaacatattctttatgtagtaaaagtgttaatgccaatgccgctgcttcaacaatatattggtcatagtccgtgatctctccccaataattttcgctgccagggtcggttcctgtcattaatttagcaacataggcatctcgcaacggatcatcttggcatgctgtccaataaggtgcgatcccccatagcggacgtacaagcgcttccatctctgcacgcttctgatcatatacagcaccgctgctacctaaattcaatcctggacgatcagtggacaaaatagctgcccgcaacggttgcatgatttgttcaagtgccgcttggtaatcctgacgagtcaaaaaaggattctcttgtaacgacgtcattgtcagccctcctctatcgatttacaaaatagaatagcaagcaaaccgggctttttcaaccgttctcattctatgaagcagtgataaaaatgagagatttttctctcgtatttctcacttaacctattaacaaaagaatgacccgtgattctatctcaaaagaggagtcgcagtccgaaaaagttaacctgtcaaatatgaaaagtctatgatagattcccagatttctcgaattttttttcataatttttttctaaaaaaagaccgacacatgttttggcgcttgaataaaaagttggctttcaaaaagctgcagacaacttactctcgggcgtgagactaagtaataccccatcaagctgtatctgctaaatagctcataaagtttctcctgtcggctctttctctcaataaggaatgatccgaggagcagacaagacaacacccttagttcttgactgcaggaagaaccattcgccaattcataaaaaagaagagtgaaaagaaactagaaatgacccatatacagggaacgaattcaaacttaatcacagcgctgctcactttgaactgatacaaggatccagctaaaataagggttagtccgatactggcaaacagagtttttaacaacaaagcaggtcttaacggtttgctgcgaatgtggataatgaccttagcaaatacatgggttaggaatagaatggttaggaagctcaatattccggaagagagcatgcttagcttcaatgctttaccagtctcttccaccagaacaatgcaaataggatggataaaataataatattgtgacagttctcgtaatttttttaagcaggagttctgcgttggattttttgagagcagccaaagaaataagaaaaaactcaacggcacaagcatcaagataaaattcatgtccaatctgtgaatgtgagaaaggaacagaccttccaacacgaacaaacttccaaataacaaaagaaaactagaactatgttttcccattcgggatagcttttcctgatgatcatagatgaaaaagccaataagcgtgaaaatcatgccaaagaacagaccatttctagtcgtaaatgttagcctaataaccagatcaaaaaaatctttaaaccaaccagatggtagaagaccatagtaggtctccaaacttccaaataaataaagaactagtgaaatgacaaacactttttgatacgaaaaacgtttcaacaaatttactataaaaatgaccgaaaggataaatgcagggatgtaccataaatgataataggtgccgatatggacaaatccaacaaacaaagccgcaggaagtagttctattggcacttcttgattttgatgaatccagtctagccccatcggaaggaaaagaatgctccatacgacgtaagagttgattaaatgcaggaaatattcttttaaatattccggtctcatctgcatccccttacggatgaaaaatgaactgctaacaaaaaagaaaggcaccgcaatacgacaaataatatttttgataaaaaaattggtctccgcttgaggaataagggtatcacaatgaatcataataaccatgatagcccctgcatatttcattctatccaatgctggataactcactctttttcccatcctatcctccataaactggtagccacttattttttcagcctaaatatatcacagcagagaaaaaatattgtccaccataagtctgaacttctacactggaagataagcaaagaaaagacgttaaaacacattacatccttcaaaaaaagaatgcagcaggttttaacgcctttcaacagtttacagccattcttgctttacaacaaaaaatgagccgcgaatctcgccagcaagtttcgaacgctgacgagcgaatttaaatttcccttctagctcagcaggaaccggcatcccttccgacagtttgataccaactgcacgtttcggaggctttccttcactggttccatgtttttcatagagtaaattaaggaccatgccactctcataatagaattcaggccaaaaaagatcgtcatcttcgtaaagtgctacttcaagaatgggtgattcaaaaactagatcccgttcttcttttaagatctgcttgatcagtgccaccaaatcaggcttctcagcagctggataggtggtatacacatatttgtatttgttccaaaagtaacgcgcttcatttgcccgcagaccggctaatttttctgcaacaggagagctctctaatccatccgtcactacatttttaaaatccacttcgtaagccatttcttttctccttacgtttatttgatcaatcaccaatactagctaaataatgattatttgatggcttgcttataacactaaagaggaatgacaggtcactagctagcttaaggaaatggtttagccagtactagttggtacaggcaactggatagtcagtcattattgttttggaggacaaagaactagttgtcattgtttgtcgaatagtaggagggatgctatgcttaatctagaaagatttttgatcaatcatctatcgatataagtttagctaaaaaaattcccttcaatctctgaagagaaaaccaataacaaagggctatgatctaagtaaacatccaacgaaatgatctgagttggaggagcggtcgaatacttttcataaagctgtgatcagaatctatgagatcacagaagcctgtctcttagtattcagatcttccgtttattaaaatacttacagtcatcccttttctgaaaaggagaatctctatgaaagtcttatttattggtgcatatggcaaagtcggtcagcatttcgccgagcaactgaagaatcatccacagatcaaggaaaaagccttgatccgaaatcctgaacaagttcctttctttgaagagaaagggatcgagacggtactactggatttggcttccagctcgatcgaaacgatcgcagaagcagcaaacgaagttgacgctattgttttcagtgctggtgccggcggcaaaggactagaaaaaacgatagcagtcgatctagatggtgccgtcaaagccatggaagcggcaaagaaagcgggcgtcaaacgtttcgtcatggtcagcactttcagaaatgatcgggaagaactgttgaaacaaaatagtttgcagccttacacgatcgccaaatattatgcggatgaatggttgagaagccgcaccaacttggactggaccatcgtccatcccggcggtttgacagacgatccgggaacaggcaacgtcaaagcaggcaaacgcaatgagttcggctcgattccgcgggcagatgttgctgccacattgatcgctgttttggaaaatgaaaacagtattggcaaagaatttgaagtcatcagcggagaaacaccaattgctgaggccattcacgaattataaaaccatctgatgaaatagtcccctttcgttaacaagcagtccctgccactatgttgtctctcaagcgacaacatagtggcagggacttttagggcgaaatgcaggctgtgccttctccaaacagcatgcttatcttgtacctttaatcattgctaacgcttgcgaaacaccatcttcgtcatttgaaacggtcacatgatctgctaattctttgattgctggatgaccgtttgccatggcaaaacttatatccgcgttcttaaacatttctaagtcatttaaactatctccaatagcgaattttgttggctggtctaattcataaatgcggctaagatgatcaaaaacaaagcccttggatacggagcgaggaacgatttcaagattgacggccgctgattcagtaacagagacatttggtatattttctatctgcggaaatagctctttttttatctcacgattagggacgaaaacaaacagtttataaacattaatatttttttgattgatgatttcttcaatcgcatcgtaagctgtcgactgaatggtattttcataatcaagttcataattcagttcttctacaggaaattcttgaccaatcgcatagaaaatgtttttcatctcttcttgatagttttgcgattcatagctgccttgattggtatatatttttgttggaaacgctgaaacgatctggctcacttcttttacagcttggggatcaaatggaaaatcaaaaatcagcttgtcttgatcgtacccaatggcaccattcaatccgaccgccgggatcgctaaatcagcttctttgaggatcgcctgaatatctcctacttctcgacccgaacaaataaagggaatcaatcactggaaagcgactttaaagaagcggcatttttatgactgatcttttgctccgagtttagtagtgttccatccaaatcaattcctattaaattcatgatatacgctcctatattgtttttctttattatacgttttaacttaggagttgaccaatacctttcgcacataggttgttatctctacaacagcgaatttattcatatgccttgacttcgctcaaacaaatgtcctaatagttagagcattgctctaactagccagttcaaaaaaagaggagaatgaactaaaacgatggatatcatcaagatattgattatgaaagactcttgtaaccgatgactttaatcagtatcctgctggaaatctatttttgcgctatctgcgatttttatccagatagacctctttaataagcaatatgatttagtgccttaattacttttattcaggccattgtcagcatctgctaattcatataccatcacgactgtcgaacaacgctcaccgacttgattcacccaatgatctttcaaaaaaccgctttgtttgaaccctactttttcgtataatttcagtgccggctcatttgtagaattgacagtgatttcgattcgattaaagcgattttgggcagcaatcctttgcatgcctttttctaaagccgctttcccatagccttgcctttgccttgacagttcaccaatctttatatcaaacgttgctcctttagcttcgataggcttgtaggcaaattctccaatgaggtggcctttttcgtctataatcaataaaaactcaccagaaacctcctcgtagtaatgaagcgattgctgtacttcctcaatgctcactgctaacccttgagggaaaccgaccgctgccatcacctttccgtcttgccaccatttctggatcagtgggctatcatctattgttgcttttcttaatgaaattgccaattcttttctcctttatttttatcagttgtctctctcacgagggcacatccaagaagaacctcgttcgattatttcagatacttttgcagagcattctcacttcttctatgacctcaatagaaagtctatttaataaattggtttgcctattaatcaatagtatggcataaaaataagcagcagtaaacgctacctgaatttctaaactttttctataaaaaaacagcagccactggatcttgtctgcccctttggttgctgtttttttaaattgttgtcttcagttgtgtttttttacagtatatatagtgttaaaccctgtttcacaaccagttaatctgccttttctaaccactttcgtgatttttcaacctcttgataggtcagttgatgacttggggtccaaacatattctatttgtgcacctcgagactcaaaaatcgcttgcacatacttgctgtcttccacagaaacgatagggtccttcagaccaaaactcataaatacgtttgtttgtgccagtaggtgattgggtaatttcgatactggatacattggatggtacaaaatcgctttttgaaaaagagcactgaattccagcaatagattgagcgcaatattggctccattagagtaaccaaccaagacaacttgttcgattgagaaacctttttctttagcgacttcttgaatgaatgctgccagttcttgcccccggaacattaaatcttcttcatcatagatgccttctgctaatcgtttgaaatagcggggcatgccattctctaaaacattgcctcgaatacctagcaatgatgcttggggatctaggtcgtgacctagatcaagcaaagagcgttcatcgccgccggttccatgtaacaagacaagtacgggagcagctggttttccttggtgaaagataaagttcatttgtcctccttctcgtttggtcgtgccaaatcgaagatctcgccgatctcagcatacgaatttcccgcaagtcggctaactgccgccaattttttgggattgatttttccttcttcatagacctgttcatttatttgatacccagtgattttaagtaagagcagatccacttttatctcttctttgtttttttccttggtttcttcctcgttaatcggtacatgttggtaaagggtggtttcaaagcgaattttcgcctcttgcaatccgggtacgccaaccgtttgagaagggactggcgtaaaatttgcgacggtcaattcactttgttctgcaggtaacagtgccgctgcctgattggctgcttccacattgctgcgatccaagatatggatcactgcttccttggtcgtgagtaagttacgagccgtatctttcatcgtgcccttttttcgctgaacagcgatcgaaacgatggcgggttctgaactgacgatcgaaaagaaactgaagggggcaatgtttacggtcccttctgccgatcgtgtcgttacgatggcaaccggccgcggaatgatcgagccgatcaataatttataattttctctttgcgtcagattttggggatccaaataaatcatgcaacaccgctttctcttttttgtgtatgattgatgacttcctacttgtaaattaaacagtcaatttgggtaaatgagctgtgatttctccgcggcgctcttcaaagtgagggggcaatttgagtgctgtccccagggtttccaatggttcatcgatgagaaatcccggagattccgttgcaatctcaaaaaggatcgtaccaggctctttaaaatagacggctttgaagtagttacgatctttgatttctgtaacaccatacccttttgtataaaggtcatcttgccagttgatttggctttcctcattcggtaccgaccaggcaatatgatggacggtaccgacaccccaacgaccaggtctcagtggctctgttggtaggagaatctcgtgtttcactggtccggcagtcaccaatcgtcggtttgattctgtctccgctacaacttgcagccctagatcatgggtcaacgtcttgaatgtttcctctggcttagcggaaagtaagaccgctccatggaacccaagaatcgcgtttgtttccgctgcttccccttccactagcgctaaagacagttcatgaggatcttgaagttccaatgttggttgcccaaatagatggctctcatgaacagtgacttgatgatgggccaattgttgtttccaatagtcgctgctgcctttaggaatgcgaaaggtaatcgtgcccacctgtccgctaccgacacgaccaggatgcgcgttggcccatgggaaaaaggtaatgatcgtgccattttcaatggacagattgctgtagtagagatgatacgtataaggatcatcaaagttgacggtttgtttgactaaacgcaagcctaatacttcgcggtagaagtctacattttcttgcgggtcaccgacgattgcggatatatggtggatttgttgaatgggttgcatcatttttacctccttagttatggctgcgagtggtatcaaacggcttgatcgctttttcgatcattgcacgttggtcttccaaaaacggagccagtgataatttttcgcccaatgtttcgtaaggctcgtcacccatgaagccaggttcatctgtcgctaattcaaaaagaatatgtcctacacgtacatacagcgattcaaaatagtagcggtccacatagccggaattcgcgagacccaaattttcaaaaacttcttgccatacggctaaagattggcgatcggctaaacgaaaggcgacgtgatgcacttccccgtctccttgttgtgcttgtgggcttgtggtatcttcgactaagacgatttctgccccattgcccccctcgccaacttctaatagcgtgcgatttccttcttgatcgatggctttgaatccaaagacattttccagtaatcccttgaaatcggcaaaataagaaacggagatttcgactgggcctaaaccataaatagcgaattcttctggaactggcccttgtttccatggaatacctgctttgacgccttgattgtgttcatcagaaatcaattggtaagattgctgatcaaaatcccagaagcgcaacacttttttgccaaattctgttgtgatcgcttcatgtttcacatcaaatgtctcaaaacgctttttataatagtctaatgcagcatcggatggtacgcgaaagcctgtacgggtaattgaatttgttcctttactgccacgatcggtattgggaaaatcaaagaatgtcatcgtggttcctggggaacctagatcatccgcaaaatatgtgtggtaggtataaatatcatcttgattgacggttttcttcactaaacgcatccccaaaatctctgtaaagaagtgatagtttctttcgacatcactggtcatggctgttacatggtgtacccctagtaattggtcttgttttctcattttttcttcctcatttctcgttataagttatttttcgtaataatgtttttaatgtttgcaactcgtcaatactaagcgaggcaaaacttgccgcaatttttgtggcatgagttggaaagatctgatccatcaattctgcccctttatctgtcagactgacataggtgattcgctgatccgtttgacttgtttctcgacgaacgcagcctttttttacgagttgatcgatgacgtacgtcgtgctgctgctggcaatcaagattttttctttgatggcttgggtggtgtgtgtacctttatgataaagcagttccagaacggaaaactctgtcagattcaagccataacagcggacatcttgtttagccacctgctctaagtgactgctgctgcgtaataaaccaatatagaccttcaatgcttcctcttgatgatccatttcctcacctcgctcgatttatttcgaattcgagataataataacttactttttgtaagttgtaaaacaatctgctttccttctgaaacaagctttgtcaacgtacaacaaaaacccccttaccattagaatccttttaagcaaaaaggatctaatggtaagagggggattgacttctatttgtagcaggtgtttattgtccaatctactaggaactacttcattaagatatagagaaaaatcaaattccgctggttagtatgaaagcagcgaggcagcctctttatcaacgatcaatgtcatatctggatgggtcgtcaatagcgttgccggaacgtcctccattactgttccatctactaattgtttgacgatgcctgcttttttcttgccattggcgatcattaccaatttcttcacctgcatgatgctttttggtcccattgttacatagaaatcaggttgtttttctttgtctccaccaacctcacttaacaaaacgtcagccatctcgggtgtcgcattcgcattcacgcgactcgttaaatctccaaattttgtcgtgttcggtaaattcccacagaaatggccatctgatccaacccccagcaacaccatatccaatccaccatcggctttgattcgttcatcttgtgtttcataattcgtccagtccaagacatggattctttcacgatcgatttccgctggtccaaaaaacaggttgtgcaagttcgtcatcgtgacaccatagcggtcttcttcccctttgaatggaatctcatcaaagttataaaagtgaacgtgctcaaaatattttttattttttactagtggtaccagcatttcatacaccccttttggtgttgatccagcggtgattgaaatattctttcgatgctggctgtgcattacgcctaaaaggtgctgtacggctacttggctcatctcttgataatcttccgtgatgataactttcatgtgtcttccctctttctcattcgtttcgtggacagcggcccttaatggaattaccttctcaaaaaaagccctttcactttctattgtataggaaaaacaggccaaattgttcgacttatctgaaatttatttttgcattctatggcgcacatctttttgatccatccgagaactacaattcttccccttgggcgaatgtacagctgcaggaaatctattcaatactaaaaaagcatctgatacagagtgaagtcggaaatcagcaatgaaatctgcacttttctcctatttacttcctaaccttctaatctgtatttcagatactttttttcagaaaataatccaacagtgaagaatcaaatgcaacgcaaaatctacctaactatagtaaaaaatcattccgcttcttcgatatcccgggcaatttttttcacgtcgatttcccgctgcaagaactcagcattctctatgggaaaatgttgacgaaactcggctacttccattacttctgcttcaccactgattaagctaaaatccagtacatgaccagcaaactgatgatcgtcactaataaagtgcagatggaagcctgctgctgcagcaccatggaaaagtttcggggtaaagaagcctacgatagttcctgctatttctgtcgccgtaaattcaggttgattttgaatgatttcaacgaattttggatagggcttttcttgtttaggcgctacccgcacgtgcatcgtatcaaacattccatgaagcttgatggccgcaaacaaattgggactgatggtcgctaatagtcttcccttgacttcttcatctgtagcttctgtgtcaaaagcaagttcatccgtggcttcaaaatcaacgacagctgcatacggcgtcgtctcggtccctgtcagctgcttcacctgtcctgtttcgtcaacatgataaatcacaccctccaagaaaataatctcaccatttgaaccagctaatgtaccgattcctgtatcaccataggctaacatcttgccgatttgttcggtaccatccatcaaatcttccatcaacccgcctaaagttccgtgttgatataaataacttttgcttttcacgttcatcatgaagctccttctattagtaaaataaatactcttagtaaaattgatccggcaaaatcgtcttgcctaattcggcattatcggaataatcgaccgggatatcaatgacgactggtccatcagttgcaaacccttcttcgatcgcggctgtcaattcttgttttgttgtggcacgtaatccttttgccccaaaggcttccgcgtatttgacaaagtctacaggaccaaattgaacacctgaagcacgatcatatttcatttcttcctgaaatttcaccatattgtaggtgccatcattccagataagatgaatgatgttctgttttaagcgaacagccgtttctaattcttgtgaagagaataagaaaccaccatcaccagatacggaaataatttgcgtattcggccgcactaatgctgccgcaattccccatggcaatgccacacctaatgtctgcatcccattactaaacaatagatggcgaggttcataactgcggaaatgacgcgccatccaaatgtagtgactgccgacatcaacagtcacggtcatctcatccgtcactttttgctgcaatgtatcaatgatctccaatggatgcaatgtttgttctgttccacgggcctctatttgcttttcggttaatttttcttgcaacgtagctaaatagttctgtgcatctgctgataacgtatattgatcgatggcttgtgtcacttgctcaatgattttggcaatgctgcctaacagctctacttcaggctgcatgtatggatcgatttccatcggtacttcatcaatcacaataatccgtgcgtctttctctgcattccaattgcgcgcttcatattcaatcggatcataccccacagcgatcactaaatcacttcgttttagcagcatgtctcctggctgattacggaacaagcccacacggccaaagaaatggtcttccaaagcacgagaaatgattcctgctccttgaaaagtttccacgactggtaatcccgttttcgctatcaaatgacgaatggcttccgtctcgctttcagcagaagcccgcatgcctagtaataaaaccggtagttttgcttccttgatgcgttcaacgagatcctcgatatcctctggattcgcttgtcctaattttggcgctgataatggcttgatggcacttccttcgacttggccatccgttacatcttgtggtatcgacagaaaactggcacctttttttgcggttttagcgattcgaaatgcatttgcgatattttcagataatgtttcgggatcttggatctccgtgctgtatttggttattggactaaagagagcagcgttgttcatactttgatgggtcagtttcgataaatcagaacgtttcacttgcccagccaatgccagaactggatctccttcagctgtcgctgtcactaatcccgttgctaaattactggcacctggaccactggtagcaatgactactcctggctctccagtcaaacggccaatggcttgtgccataaatgcagcattctgttcatgccgggctaagatcaattgtggtccatggtcttctaatgtatcgaagacaccatcgatttttgctcctggaatcccaaaaatataggggacgtgatgattttctaaactttcaacaataatttctgaaccttttttactcactgtactacctcttttcaaaatctgtattaatctcacgactaataatagcacttttcttttatttatcaagaataatacactattttcatctgtattaaaaaaatagcaattaaaaggaaccgttttctagcgctccctaaaaaggattctataaataagaacgattcgtaaaaacaaattgttattatctagttttattttcttatttttttcatgtttttaatataaatcatgttataataaagacatcaaaaagtgaaaggaactagaaaagttatgggtatgtggattagtttggtcagtttcttagcagtaattgtaagcggtattttgttgattatcgctgccatcaagaagcgaccgaaaaaaagattgggatttattttatgcggaagcgttattctattttttgctggtgcaattttatctccgagcaatttgacactatctgttatttcacctgaaatacaaacggatgaaacaggaaaagcgactatcgaaggggaagccacggccgatgctgtcctaacgatcaatggggaaacggtcaaaaacagtaaaggttcttttagctacacagttcacctgaatgatgccactgagcaacaagttgtggtaaaagctgccttaaatgatcagaaaaaagaacaggaagtcttgatcaaaccttccaaagaatttgtggcttatttagaagcagaaaaagcggagaaagaactgattaaacaggtcgaaactgcactagcgttggcagaatctaaaccaacacaaaaaaattatgatgaagcagcaacattggttcattctctcagcaaaacatatgacgattatgatcaacgtttggccgtcctccaagatcatctgcagatcgccagcgcgttagaaaaagcggaacaaagtctaagcagaacagaccttgaggcagctgccaagcttgttgcagcaacaagttcgacgaaaactgaatttgaagatcgactggcttctttacaaacaaaagttgaagagaaagaaacacaagcgaaattgcaagcacaagcgaccaaagctgttgaaaaagccgaagcagagccgactgaagcaaacttagctagtgcaacttctgcgattgccaagcttccctcagcagatgatggattgacgcagcgagctgaagctgttcgccaatcgattcgtgaagaacaagaacggcagcttgctaaagccgaacaagaacggcaagcagccgccgctgcgaaacagcaggcaaaccaagccagccagtcaaatcaaaccacaagcaatcaagcagaagaatatgtcatgatcacccgtacagggaagaagtatcacacccataaatgcggcaatggtacttatttcccagctacgttgtccgaagctttaagcaaaggattgaccccctgcgagaagtgttactgatttttttgaatatggaacagaatctagacagcgttcttcctttctaatcaaagaaaagaacgctgtttttggcgaacaaatatgcgggtcataccattcttcctaaaatatctagcaggaccgagatacgtcgaagcttgtttggtcgtagaaaaaaacgtcaaggctagtatgctcctagcattgacgttcatcgtattttctgtagattatacctgttagatagaaataacacgctggttgcttgtcaaaaggacttagaaagataaagcacaagatcgtcattattgtaacaagcagcacccattgccaagacttgattctcaaaccagacccctgatccgtcaggtaagtagccattttttaaatacagtcgctgtgcagtgccataaccagaatgaagccccacaccaatggtgatcacagacgaaaatgttttggcttgttcttctgcagcttggagcagcttagcgccgattccttgccgctgaaagttttgaaagacatttagatcggtgatctccggatagccattctttttaaaaggaccggcttttgcgtggggaatcaatgtcgcatagcctgcaatctgtcccgagtcttccgcgacaaagacctgtcgcagtccgcggctctgttcttgaagatatctctctaatgtagcttgacgactaggccattgttgtgcaagaaacgcttgatcgattgatcgacaatcactagctgtcattgggcgaataatcaaattgatccctccataaatttcattgtctcattgattataacgcatttcggctcaagcgttcgacttttcccatgtccttgcagaatactgctgccccagttgccactagcagttgctttattcacccatcaacataagatggcaggttcgattcctaactcggttttggtcaaaatccacgaaataaatataccctacagaaccaatttcaagctttccttcatgtaaaataaaactttcactcgccccgaaaaacgaagaacggatatgggcatcgccatttaaaatcgttgctggatctgtcggatagttaggatcatctaggctcatcagaaattccaaatgtttcggtccagggtaacgataatttgtattttccgagagttctctaggcactagtttatccaaaatgcgattcagatcaacttgtaaaaattcatccccattaaaatccgtatcatgcatgaattcctcgaaaatgacggaacaagttgtgtgtggggattggactaaacagatgccgtttttgatttggcttctctctacaaagtccttcacttcttgcgtaatattatgataagatacccgattgccatttgatgtcaatgttagctgttctttcgcgaatttcatcttttaatcccctcatctcttagctcagcaacttttttgatcatttctgtcaaaacgttctgcggatctggcgcgcagacgataccactggtgccacccgttccgtcggctcctgattgcagtgcttttgccacatcgtctgcggtcgaaataccagccgcttgtaaaatcttgatttctttgttgatggcacggatggcttgattggtttcttccatataagaaacgtcactcgtttgaccggtaccaatcaattcagttggttcacaaaccataatgtcaggctgcagagctgccactgctttagcttcttgcagtgaattcgcgcaagcaatcgtgatgagccccaactcatctgcccgattaatcgcttttgcgagttcatctaatgtcattgggtgttctgcatgattgagaaatgtcgctgctacgccgacatttgctactgattcaggtaagacgtagcccattccccgtccaacagtcatgccatcgatgtgttgaaccgtaatgaacaaatgattcgtagcttgtttgatcgttgcggcatctgcgtgctgcaccgtgaacaagatatcaacgtcatatttttccgctaattgatcggcggcttttgccagtgccaaggattcttttccgtataaataggctttgggattgactacaaaaaagggtgctcgtaactgctttttcctcatgcttatcctcctaacaagtttttgtatgaaaaacgtgatagtaatgtgctagcgtatctgccattccttgattcgctgctttctttagttcaaagtagtcagcaggctgctgttcttgaatcttggtcattgcggctgtaacgaaatctgtaaagatgttgatttttcggatcccgccttgtgcacatttttcaagattttcatcaccagaagaagaaccgccatgtaagactaacggaatagtaatggcttgatggatctcacttagtacatcaaagttgattttaggcgttcctcggtaatgcccatgggctgtgccgatcgaaacggctaacgaatcaacattcgtttgttcagcaaatcttactgcttcatggaagtcggtataaatcgaatcagaaagccccgttgcttccaaactgccgccagagccgacatacccaatttctgcctctacgaccaccccatattgatgggcataatcggcgatcgctttggagcggcggatattttcttcaagcgggtcttctgacgcatcgatcatgacagaagtgaagcctaaacgaatcgcttccttgatgacttcctcatcttgaccatgatccaaatgcaacgctacggggaaggcgcttttttcagccaaatacttcccaatcagggctgcttcttccaaactcagcatatccatatgtgattgggcaaaagccaagatcaatggacaccctagcctagcagccgtttcaacataggtgcgggcactgtctagatcaaaaaagttggctgcgggaatggcatagttgaattcctctgcatggtcaaacatttcttttgtggtaacaagcattttgcaagactcctttattctctgattttcttttcgatttctgcatacatttcttcgataccgatccctgtcaataaaggcaatcccatgatgactttgtctttgatggaatcagggactaccgtggtactcacaacaatgtcgtaatcgtcgatcttgttcatttcatccgcgactttggattgatacaatttgacttcattcgtcagttctttttcttttagccattctttgactttattggttacgatcgttgatgtcgctactccggttccacacatgatcaataattttttcattgttcttcctcctacatgacgctttgttttttaggtaacaccttgttaacatagatcaaaccgatgacaacaatcgcaccgatgatcgctaatccgccccagctcaatacttttgtcaaaccgacataaagccaggtagtccatagtccgccttcagctagagctgtgatcgttgaatttccttgtaagtcaaaattggcagacttagcagctgttgttactaatggtgcgacccaagaagtgatatacaaaatactggtcatataaattgtccctgcgataaccgtccggataatatttccgccaaatactgctgccatcaaacagacaagaaacggaatcgttgctaaatctccaaaaggcaatgtcgtatttcctggcaaaacaaccgctaaaagtatcgtaattggtacgagtaataatgacgaagacaatactgctggatgtccgacagaaagcgccgcatccatcccaatgtaaagctctcttccagggaaacgtttcttcacaaagtcattggcagactcagatataggtgtaagcccttccattaatagagcaaccatttttggcataatgaccatcactgcgccggttttaactgctaattggccagtgcctgccacatcatagccagcgagaattccgatgatcaaaccaatcagaaagcccataactgtcgagtccccaaagacaccaaaacgtttttgaatcgattccgggtcagctttccagtctcgcaatcccggaatacgatcgaataaccagttcatcggtaaagcgaaaacaaatcctggagcagcggtcccgtgtgggaaagtgatattcgggaaaccatagaatttattaatgatcggtcctaaaatatctcccatcaaaagaatcatcattagatagatgacggttgcagcgatccccatggcaaagttgccagtcaaagcatagaccaacgaagaaatgaacgccgcatgccaaatattccagatatcgacattcaatgttttcgtcaggccaaaaataatcaaaacaacatttaacacaacaccgatcggaattgccagacttcctagaatcgtcccataggaaatcgcagctgctgccggccagccaacatcaatcgtcgtcagattcaagccaaatcgctcaaccatctgttgcgctgctggtcctaagctattgcttaacaggtcgatcactagattcaagcccacaaaaccgacaccaactgttaaagcagatgtgaaagccttgcctggtttcgttcccagaataagaccaaaaataaatatcaaaatcgggagtacaacgattgaccctaaatcaacaaaccactgtaacgcatttaacatgatattccctccttattccaatccatactgttgcaaaatcatccgatattcctcaacatcatggatgtctcttaacttttccaacacaccatttttttgaaacatttcgatcaagttttgcagcatttgtaattgttcgtgcggctcctttaatgccaacataaagattaatgaaactgaaatttctttgtcccttgttcccatttcaatgaatggcaatggatctgtcaatgaaagaaagccaacttgcgatctcttgacatactgactatctgtatgaggaatcgccacgccaatcccattgatcatcagaccggttggaaaaaccgcctctcttttaatcacgttgtcaagatacgcctctgtcacacattcattctttaaaaattcctctgtaagtagccgaaatgctgcttctttagattctacttctttgtttaataaagcaatttgctggtcaaaaaacattcggggtccctccttttacaagtttacgataaagttcttctcgatttttactgctaaccacccatcgtatttcttcaggagagttgaataaatcgtaaatagatgcaatcaattcttttgcttctgacatatttttttcagcgattgccaagagaacgactaattgaacttccgtatctccccattttatggctttaggtagtgtaacaaatgctagttttgttgttttgacagtctgcggatcggcatgcggaatcgctacgcctgtctttaatccggtactgcctaattcttctcgtgcataaagtgactgcttaaaatcgttggtgactaaatgatggctcaaataactctctgcaagaaaatctaagacgtcttttttggtgttaaacggttggttaatgtacaaaaatgccggatctagatatttctgcaatagctctgatgattggtatttggatgaatgcagtttcttttcattttcattcaggtttgaaagatttgccgaaatcatggcaatttcttcagttgtcggtaatggtgaaacatagagaacagggggtgacacttcctccaacggaacagttgaaatgatcaaatccactaattctagtgatgtactggctaatttctctgcactgatgatctctaaaactgtcgtagcagaaatcgtttgtttgatccggttaaagatcagctcagaagtggctaatccagagctgcaaacgatcagcacatgctttgtgactttgattttttcaaaagcgagttgaaaatgaatcgttagaaatgacacttcatcttctgtcaagaagagtgcaaagtttttttctagtccgccaatcgcatatttcgttaatgtaaacatggtcgagtattgcttcttgatcaatcgcaacaaaggatttttgactaacatgccatttttcagacgatggatcatagggacaatatgcgaaagcagtgcttgcaacaataagttatcttgtgtcaaatcagtatctagcaaacgggacatcttctcgatcatttcttccgttgtttcgatcacgttggcttctcttttttccgtaatctgcatatacggctcaattccatgagctaaaagcaatgaacaaatgtattggatatctgtctctgctagggaaacagctagttcactttcaatccgttctgcaaaggaaacagcaaccatatacagtttcatctgttttaatttctcaaatcccaaattctcttgctgttccaaatgtcttcctagacaaatccgtgaaagaaaaatttccaacgataccgtcaaggattccacaaaataactattgagttggcgaccaagtgttaaggatatttctgaaatcagtgctgtagtcaaggtaacgatcttcggatcaaacaatgtctgaatggcagagtgatccaatcttgcagaatctgtatgtttttcaagaaaagatttgaaagttgcttgttgaacagattcttcctcctctagcttcaacccttttgcagacattgacgcacgaacttttttcttctgacaaaaagcgaataattcatctacatcttttttgatcgactgataactaacgtagaaatattctgcaaatccttggtaatgcattggctttttcgagaagaaataatttgcaaagataaacaatttacgatattcaggagaatattcgtcaacgattttaccttcagtaacgatgagtttgtagcctttttcccttgcagtgggattcccttcaagcttgacccctcttctaggcaaacgagcaatggtcaacccgtaaggcttgattttttcttccagactcgccaaatctgtatagactgtttttaaagaaacatagagctgttcttgaaaaaaagcggctggtctgaactctttttgtgtcagcagcaattgcaacaacactttctctcttttactcaaatccatttgaccacctccaggaagcgcttccttaactatatattagggaatcagcgcataatagtaaataatatctgattaccacattaatctggtaattgtatcacatagtgaccattccaccactagacaaacagcttttcaatctggagggattcttgtatgctaagtaaaacaatgaatgatagaaaggatgaaccaaatggagcacacaaacgattcattagaccgaggaccttttttccacggaacaaaagcatcattacaattaggcgaattactggaaccaaaaaaagaatccaactttgaagccggtcggatctcaaactacatttacttcaccgcaacattggatgcagccaaatggggagccgaattagccaaaggaactgggcaagaaagaatttatttggttgaaccgactgggccttttgaaaatgacccgaacttgaccgataagcgattccctggtaatccgacccgttcctaccgttctgcctctccgctgaaagtcgtcgcagaattaggggcatgggaacggcattcggaagaagtgattcaacagatgttatcccacctgcagcaactaacagaagatggaaaagccgaaatcattgattgacagttttcttagcacgcaaacgccacccttgtttctggccgtcgaaaagaaaaatattccaacaagtgccatgctacaatgcagaaaagacactgattaaaagaagaaagtaggaataacgatgtatgtaggatttgatattggcggcacaacgatcaaatacggggttcttgatgaaacaggagcaattctggaaaaaaatatgcttccgacaaactacgatccccagtctttctatcaaaatttaatcacaattattaatgaagctaaaagtcgctatccgatcgccgggattgggatcagtgcgccgggcatcgtgcaaaaagacggtttgatgctgacagctggcgccatcaaaccattgtacggcgagaatttcaaaaccacattagaagaatgctgtggtttaacagtttctgtcgagaatgatgccaatgcagccgccatcgcagagaaatggatcggcaatgcccaatccttctccaattacctttgcctcgtcttaggaactggtgtaggcggagggatcgtaatcaatgatcaagtgtatcgcggtgcccacggcatggcaggagaatttggctggatggtgatcgacgccttgccttctacaggtaatagtgaggaagtttcgatcaatcgtaaagctgctgtcgttgatgggctcgttcggatctacaatcaaaaaggcggtcagctggcaggatttcaagcgacgacagatgctcgagaaatttttcagcgcgcacagatgggagaaacattagcagaaacagtgacccaacagttcctgacagatttgtccgtcgggttgatcaatttgatcagctgtttcgatccagaagccattttgattggcggtggtatcagtgccaacccatatttctttgaacgactgcaacagacattaacaactgtcgaaacacaacacgctgccatcaactatttgcggggaaaaacgattgctcctgtgctgcctgccaaattgcaaaatgacgccggattaattggtgcagtttatcagattcatcagcaactcactcgctaaatcatggtatactcgtcatatactcttatgggatagcgaggaacatttatggccgtttttcagcatttgaacttaaacaaattgtcttcagtcgaacaagagatctatcgctttattgtcaataatttagaaaaaatcccttatatgcgagtacgggatattgcagatgatgcccatgtttcttccacttctgtctttcgttttgttcaaaaagtgggattcgattcctttcctgaatttcgcttttatatcaagacccatttagaaaaagtccattatgaagaacatcaaaaacagttatcccttgaagaacgcatccgtggattgaacatgacgattttccatcccgatgtcgaataccaaatcaagaagatggcgcaaacactgcgagatgcggactgtattttatttatggggatgggggcgtctggagcaattgcacagtatgtcgcccgcaagctcgcaaatatcggctacttctgcatcagcatcgatgaattgacttacccgatccgcagcttcttacgagccgatcaaaaaaacgttctggttttcttgagtgtttctggtgaaacaaaagaattgatcgaagtcattactggattagctaataaagcgattgcccaaaaatattgtattacgagaaataaagagagttctcttgcccatttatgtgactactcgatcgaatacgcagtcaaagaagagcgcaaagacatcttcctcgatctgactagccagcttccagccatcgccatcgtggaaacactgattggttatttacaagatgaacctacccctcaatgatgaacgagcacagaaagtaccagacaacgaagaacgccctagccagaacactcgctttacagcagcagttttctgactagtggctgcaatcaagcgtttgtcttgctgctttctgttttttgtaaccacttgttccgactgtggaataaatttcttcctcacagaatttgattctaaaaacgaatgcgcttactttttcaggcaacctttcgctataataagtccatcaaatagagaaaggtgttactgttatgcaaaaatttaatgatctactagaccggtccttggtaccaattgccaccagattgaataaccagcgacacgtcgcagcgattcgtgatgcatttatgttgattttcccgttgacgatttcttcttcattagttattttggtcaacaatatcttattttccaacgatagttttatcgtgcaattatttcaactctcaaaaatctttcccaatttagaaagtgcccagcaagtactggcatctgttgctaacggaaccatcaatatcatgagcgtattcattgcttatctggttgcccaactgctagcaaaacactttgatgcagatgcgacactagttggtttgacaagtgtagctgcgtttatgattttatatccgacttctttctcagttgacggtgtcaatgccatctccacccaatatttaggcgcacaaggcttattcgtcgccatgatcgttgcttgtctggtaggagaattcttgccgaaactattcaaagtcaaacgattacagatcaaaatgcccgatatggtaccgccggcagtttcccgttcgttttctggaatgattcctatcgtgatcatcgtagcagttaccgcattgatcaatttcctagtactgatgattgcgccagagggcatcaatgaattgatctacaaagggatccaaagtccgttgcgtgatttaggaggaaatgtcgttggtgtcttgattttagctttcttacaaacactgctcttctccatcgggattcacggaccaaatacattgaatgccgttcgttcagcaatttttacagaacaagatttagccaacttggatttcatcaatcaaggcggttccttgtgggatgtaccttacaaagaaacgtggggcgttttgaacgacatgtttgctaatatgggcggaacgggaatgacgttagggctgatcattgccattttcatcgcctcgaagcgaccagaacaacgggagatcgctaagatgtcacttgttccaggaatctttcagatcaacgaaccgattatcttcgggttaccgatcgtcttgaatccgattatgatcattccctttatattgactccaatggtcaatattctagttggttattttgtaacagtcatttggccgatcatgccgacaccagcaatcggtgtgccttggaccacaccgggaatcatcaacttgttcctaggaactggcggaaatgcagtagctgcaatcgttggtgtggtctgtctggcgatttccgtattgatatacttgccattcgtgattgcttcaaaccgttcacaaaaaatcgaagcgtaacttttttaggaggaaagaattatgagcagcaaaatgccaaaagattttctatggggtggcgcaattgctgcccatcaagcagaaggggcttggaatgtcgcaggacgcggcatgagtattgctgatgtgatgactgctggaggaaacgggattcctcgtgaaatcacgagaggcatcaaagaagatgtgtattatcctaatcacgaagcgatcgacttttatcaccgctacaaagaagatattcaattattcaaagcgttaggcttaaagtgtctgcgtacatcgatctcctggagccgtatttttccaaccggccaagaggacgagcccaatgaagcaggcctgcaatattatgatgacctttttgacgaactattaaacaatgggatcgaaccaatcattacactgtctcattttgaaatgccttatgcgatttatgaaacctacggtggctttgtcaataaagccgtgattcccctcttcgttaaattcgcaacctgcgtttttgaacgctacaaagataaagtcacctactggatgacattcaatgaaatcaataatcaagcagacggacaggaactattacatgtctggacaaactccgccatgatcatcgaagaagaaagcaagaaagaagaactggtctttcaagcgggtgtcaacgaactgatcgctagtgcggcggcagtcattgaggggaaaaaaatcaatccagactttcaaatcggctgtatgatggcttatgtcccaatctatccttattcctgtgcaccagaagatttgatggcttcggtcaaagccaatgaacgtcgttacttctatagtgacatccacgtcagaggaaagattccgacctatgcacaaacttactggcagcaaaaagggatcaaaatccaaatcagtgaggaagagaaggctttactaaaggcagggactgttgattatattggtttcagctattatatgtcaggaacgatcacgacattggaaactgtcgaaggccaaccgaccgacgatatccctcacgcaaaaatcgtccgtaatccctatatcaccgcgacggattggggatggccaattgatcccgtaggacttcgctatgttttaaacacgatctatcaacgttatgacttgccgctctttatcgtagagaatggctttggtgcctatgatcaattaacagaagaaaacacgatccatgatccctaccgtatctcttatttacgtcagcacatcgaacaactggagaaagcagtaatagaagatggtgtacccgtcttaggttatactccttggggaatcatcgatatcgtcagtttcggcagcggagaaatggagaaacgctacggcatgatctatgttgataaagacaatgctggcaacggaagtctgcaacgcttgaaaaaagattcctttgcttggtatcaacgggtcatcgctacgaacggtgaagaactttaacagaagtcttgctactatcccaaaagtaaaagcgactacctaaaagactgttctttcaggtggtcgctttattaaggtttcttatttgatttcctctatactagaagtgattacccagtcatccatgttcttccctcgttgatacgtaaaaggttcaatcgcttccagttcagcaattcgataaatggccaaaaatttctttcctgcccaacgctccatttgttttttggataaatttaattctgattggtgctgctcaacaaattgttgtgattcttcaggtgtcattttctccgtttcaatcacgttctcaatcatgccacgatgagtaactaaaagatcgccacctgtttccacgaagtagacacggtcgccaacttttgcgcgtccacctaacggagatttgcgccctgctgccccacggatgatggcgttcttttctcccgccaacaatttctgcagctctttgccttctttgtttagatagactagatgctccgctactccttctttgccttcaacccaagaactcaccatttccttttcaccttttttcgattatcatagcagaagaaagcggtttagactacaaatttttcatgtcattttaatcagctagttccccttacaaatgacgaaaaatgcgaatatatcagcaattcaacgaatcgttgcgttctttatttcctgattcaacgattcatttcttgcacctatcaatcaaaggaggctactctgatggtagagattggagaaaatatcaaaaagttgcgcaaagcaaaaaggatgacccaaaaagaggtggctaatcaattgaatgtcacgccgcaaacgatttctaaatgggagcgaaatatcagttatccggatttggatatgttagtcaagctaagtcagttgttccatatttcaaccgatgctcttttaggcaatacaaaaccaactttttttgcttccttattctcaaaaaagaaaagagggaaaacgatggaaaaagtaccagcaactccgtccactatccaaacagacaagctgtcctcatctgagaaacagatcatgatttttagtgtcagcagctggataaccgagggagaactgcaaacacaacgtctgcagttaaaattacagaaatattttactgttcaaaggcagccgattgcggtagagatgtacagcttgtcaaaagtcgcagaaaaagcgccagctgctgatttgatcctcctgactcctgaagctcaatttgcattaaaagaactacaagaagccgtaccacacaccccgattcttttgcttagtagccaagagtacggtctactaccgattgaacaaatcgctgaaaaaagtttgcaagccatgctttagagcgttcaacaaaaatagagcgtggaacaaaagtaaaaaacacttttgttccacgctctaaacacgtctaaacggtgagaggcgaagcaactccttcggaaataagtcgaaatacccccaaatttgaaaagtaatttccgtgtattcctccttatttctcggagtttaacacttctgtcccagcctctttcttatcctgtattagattttcagcaaccagatcaagctgagcgctgcaattgtttgaaccaaaccgactgaaagtccatagaaaaggaacttaggtccttctttcatgaatttacggaagtctaagcgcaagccgattgctgcaagggcgatggtctcaaaccaggtactgatgaaatgtgcagcatcattcaaccaacttggcaatgcaacgaagctgttcaagatacaaatcagcaaaaaacctaaaacataccaaggaatacgcaacgatcgtttttgttttacgacggatgcggattgattttgttgcgacaccattcgttcgaaaatcaaaaccaccacgaccaataaaatgatccgagcgatcttaaacagcatggcatatttgacaatctctgcatcaagtaagctggcacccgctacgacttgtcctacggattgtagcgttcctcccaacagtgcgcttttttgtaaaacatccgaaccaaacaacgccagaccaagaaacggcaaagtcaacatcatcactgttcctaacaaattgacgagtgtgatgatctgccctttttcttcatcatcggcttggatggctggtgcaatcgcgccaatcgcagaagaaccgcagaccgcattgcctcctgccatcatcaaactcattttttgattgaatcccaacttcttgccaatcaagtaagccgcagtaataacgatcgtcatcatcaatacgatgaaaacaaaaccacgaatccccatctcactgatcgtttgaaaggtaacagtaaatcctagcaatacaaccgaatattctaaaagccgactttctgcaaatttcgttccttgcgcatactgtttttgattgaagaacgtattgcctagaacgatccctaataaaatcgccaaagtcgctcctcctaattgcggcagccaaagagccaagactttcgctacagccgctacaataaatgataacaacaagccaggtaaaaatggctgcagattgacgggtttgattttttcaacattcattcttgtccatcctttcatactgccttatattatacacagcatttttcatctataacatttattgatataatagttttaataggattttataatggaagtgattacactgctggaaaaactagaaacgttcaaaatcgtttacgaaacacagaatttctcgaaagccgctgagttgctgttcgtgtctcaacctaccgtctccgcccatatcaaacaattagaagaagaattgaatacccaacttttcattcgaaatggccgcatgaacatttcagcaaccccacaagctcacctgctttatcaaagagggctgaatttattggacgattggcagcatctctatcaagagatccaacaaggtacgcaacagttggttccatgccggataggtgtttcccatacttttgcgatctatttgctgccggatttgctgatgcgcttatacactcgctttccccacatccaatttcaagtagagatgatgaactctgacgctgtcctgcatgcggtagagcaacacgagcttgacctagggatcattgaaaagcccttatccgctgctaccgtggagcgatacccattgatgagtgaccagctagtattggctggcgatccggcagtcggaccgtggcttgtgcgagaacaaagttctggggtttattattatatgaaacgctatctagaagagcaaaatatccagacgcctattttacaaatcgccaataatgagatgatcgttgcattgttgaaaaaaggcttcggctgttcaatcatttctgcacgagctgctggagatgtcccccatgaagatttaggcgagcgttatcgccgccaattttatttggtcaaacggacccgcgattcctataaagaatttgctgcttgtgcttcttttatccgacaatggcaggaggaataatcggtgtctcttgatgccatcaggcaacttcttaatcttttcttacgattgaactgatttttttggtaaaaaaactcattcattgtttcttaattattttgtgatagaataataggggctctgacgttcccctataaagtaaaacagatgtgaacgaccacctagaaaggaccctgaaatgaaggaacagatcaaaaacaaattagctctcttacccgatcaacctggttgttacttgatgaaagacaaaaatggtacgatcatctatgtaggtaaggcgaagattttaaaaaatcgtgtacgttcctattttacaggaagtcatgacacgaaaacggaacgcttagttcaggagatcgccgactttgaatatgtcgtcactgaatccaatactgaagcgcttttgttagaaatcaatctcattcaaaaaaacaaaccaaaatacaatattatgttgaaggacgacaagtcctatccatttatcaaagttacgaatgaacgctatcctaaattgatcatcacccgcaaagtgttgaaagatggtgcgctttacttcggtccttatccggatgcccgagcagcgaatgaaacaaaacggatcttggaccgcttgtttccattacgcaaatgtggtgcatcgcaaaaacgcccttgtctctactatcatttgggacagtgcgtctgtccttacgttcatcacatggatcccaaggaataccgaaaaatcgttgatcaagtcaaacactttttccacggtggccatgttgagatccaaaaagaactaaaggaaaaaatgggcgaagcgattgaatcccttgaatttgaacgtgctgcggaactgcgcgatcaactccaagccatcgataccgttatgacgcgtcaaaagatgactttgaccgatctgcttgatcgcgacgtcttcggttacagtgtggacaaaggctggatgtgtgtccaagtgttctttatccgccaaggaaaattgattgagcgggaagtctccttgtttcctttttacaacgaagcggaagaagactttttgacattcatcggtcaattctaccaaaagaacgagcacttcatcccaaaagaaatttttgtcccccaaacgattgaacgggaacctctagaagtgctgctaaaaacgaaagtcttgcagccacaacgaggtgacaagaaaaaattggtcgacttagccaataaaaacgcgcaaatcgcattggatcagaagtttgctctcatcgagcggacagaagaacgaaccatcggggcggtggaaaaattaggtgaagccatgggcatttcggccccttatcgcatcgaggcgtttgacaactctcacattatgggaaccgatccagtttctgcaatggtcgtctttgtggacggcaagccttcaaaagatgattaccgaaaatacaaaatcaaaaccgcacaaggcggtgatgattatggctcgatgcaggaagtgatctaccggcgctactcgcgagttttgaaagagaaattgccatttcctgacttgatcgtcatcgatggtggcaaaggtcaagtaggcgccgcacaagatgtcttgcataaccagttaggattagatattccagtagctggtcttgtcaaaaacaataaacataaaaccagcgagttactgtttggcgatgatctgcagccgattcagctcgaacgaaattcagtcgaattctttttgctgcaaagaatccaagatgaagttcatcggtttgccattactttccacagacaattgcgcagcaagaacagtttctcttcaagattggatgaaattcctggtttaggaccaaaacgtaagcaacagctgatgaaaaccttcaaatcgcttaaaaacattcaagcagcttccgtggcagagatccagcaagcgggcattccgcaagccgttgccgaaacaattttagaaaaattatccgatcaaaagaaaaccacgtcctagaaacactcggacgtggtttttgctggaatgaatcatcgaattgtttggaaaggccactaagacataaacgtgctctcaagggaatagcggaatgtttcgttccctttcaggcctgtctcttagatggctctttcacaaaattcgttacccagatatctagatatgttttcctaagcaatcaacaagttgacacgcaagccatccagttcagctttctgctcttgtgtgatatgagaatctgtaatcaaataatcacattcatctggtgcagcaaattgcttgaaactccgctgattgatcttgctggattcacatagaacaattttgatccgactaatattgatcaggcttttcttcatttcagccgtttcgtaattaggagttgaatgcccataattcttgtcaaaagaagtggtgcctagaatcactttatccacggaaaaacccgctaatcccaatgccacagaactgcctgaaacatagggatagccatttcgaatggtaccgccaatgacttgcacttgataattggttttctcacttatcaataaggcaatctccaaatcataggtcaaaatcgtcaaatgcttcagtggactgttgatcaatttttctgcaaacgcacggcaagatgttcctgtatcaatcgccaaaatatcattttcttcgatcaatcggaccgcacgttcagcgatgcggtatttttcattggtaaaggcccgatttttggggatcgtctcaacacttcgttgaaattcacgtttaatcacgccaccgtgggttcgagtgactaacccctcattctcaagttctcgtaaatcattgcggatcgttgaacccgtcacattgaaaagttccgccaactcagcaacttgcatccggtttttctcattgactattttaacgattgattgttttctttcctctgcgtacaattgatcatccatcttctatcacctttttgtgttttgtttcattataaaagaaactgaaaatggaagcaatcaaactaaaatgattcgtcaaagacaatgacatttttcaaacctactgcattgacagcattttcaagcgcctgaggaaactcattgattgtgtaacattttgtaatcaattttttcaacggaattctgccactagcaactagctgtgcggatgttcgatagcctgccaagctggcacgagtacaaccaaaaacgcgtaattgtttgtaatgaagaatgttcgtgttcaatttgacttcctctttctcctttggcaagccgccaaagaagagacagcgaccgtttgtcgccatataactgaaacttgcttcttgtgcctgtggtgccggcgcggcaataatacacaggtctaccccttgaccattggtttcagcaaaaactttttcctgcaatccatcagaggtcaatggaaccaagggttctgttgcaaagttttaaataaagaataaaatcccttacggtatctatgatttaagctgggattcccaataataccttgatttcagtacagaccgaaaacccgaagagagtgccttcttttcgggttttcttatataatcctcgaatggcttccatgcctttaatcgtggtagaggcagtgcgtaaacttcgatagaatttattgcgtctctttactggacgatggtcttgttcgatcaaattattcaggtatttaatggtacgatgttctgtcccttgataaaagccgtattcttttagtttcttaaaggcacttgtaatagagggggctttatctgtgactacaaccttcggttcatcaaactgcttcactaaccgcttaagaaaagcataggctgcttgtgtgtcccgttttttacgtaaccaaatatccaaggttaaaccatctgcatcgatggctcgatacaaataatgccattttcctttaattttgatgtacgtttcatccattttccatgaataaaaggattttttatttttctttttccaaatttgatagagtagtttgccatattcttgcacccaacgataaatcgtcgtatgagaaacgttaatgccacgatcatataagatttcttgaacttcacgatagctaaggttataacgaagatagtagcccacggctacaataatcacatcctgctgaaattgctttcctttaaaatgactcatcgtcattcctcctgctatctttttctattattctaccttatctgatagtagatttaaaactttgcaacagaaccgtactggcgaatcacttcccccatttccatcgctgtggtctccttttcggtgaatattgataactactttgatcataacaagaatccgaacacgcaacaattgactaaatgaatcaattttctaaaaaaaaattaaccagtggttataagagcaatcaaagcggacacagaaaacttgtcccttagttgtttttgtagcaatcttgacgcaaaaaagacacccatctctgagtgtcttaccaatgactgattccccatctagtaaacagtctttatgcttcacttatttgacgattttcttgaccatgtcgaataatgttttcacatcttctggtcgcgtatcgccagtttctttgtcaataatcgaactgtaaatatgcggaatcacttttttaacgcctgcatcaatggcgatttgcagaatttcttcgaagttttccagatcaattcctccggttggttctaaataaaaatcatatttggcgcaagcttccgcaactgctttgaattcttctttgtgcgctaaccctttcattgggaagtatttaatggaacttccacccatgtcttgcagcattttaatggcggtctcgatggggacctctgccgccggtgcctgtgaacttaaaggtccagtggcaatattgacgtaccctaccttgcctgttggtgaaaccaatccattgatgactgtatcgttttgtcccaataaagcacgggaagttcctacaccagtgaatacttgattgacatgttgcggttgtaaagtaccagatagacgggaaaccatctgactttggttgggatctccggcgcccaacccaacggacaatgcattatccgttgccgcttgatattttttcatgtcttcgatcgctgcttcatcgctagtatagttttttgataacacacctagtacgacatgtcctgctgctgcttcataacaagccttcgcattttcaactgaatgagccaatacatttaaacatacgcgatctttataataatttggaataactgacaatttaaaagcctcctacatgatttcttttaagcgtttaatgattttttccatttcgttttggttgaccgagcgaatatcaaactcaataattccattatttgcttgatattcacgtgtgtagactgctgggttttgtgcctttagttcttcaatgacttctttcgcagatttcttgccagcaaccgtgacacttgcgcgataaatatctctcccggcgccatcttgaacaattttcgctgataaatcaggaagttgattgatcgccgccacgaaaggtgccaatcgttgtttcatggactcaccggattcactgccattttgcaggtaatcttctactgcttgtgtaaagcctaaaatattgtctttgccgattttcattgcccgaccgatccctttagactgtagacgaatccattgaatgtattcctttttccctatgaccagaccggcactcggaccttcgattgctttggcgccagaatagataacaaggtcggcacccatttcactgtatttgaacaagtcttcttccgcggctgcgtcaacgatcaatggcaagtgatgggctttggcaacttctaccatctccgacaccgttagcatacttttctgcacggtatgatggcttttaatatatagaagtgcggctgtttcttccgtgatcatcctagcgacatgctccggtgtacacatatttgcataacccgcttcgacgacttgtccacccccttgagcaaccattacttcaaccggtgtgccgtagtctacattgtgacccttaggtacgacgatctcccgtctcgtgattttttccgtgtagggatgataaacatggtacaggtcgccttgaccaatcaaagccgcgacagattgggcaatccctgctgaagcagaagaaacgatctgcgcatcttccaccttcaataactgagaaaggtaggcgccagttttcacagccagatcactcatttcaaaaaaatgttcgccgccaaatcgttgtgcggctagcacattttcagatactttcgagacaccgagtatcgtcatttttcccgaggcattgatgacttcctttaaagcaaacttttcatagctaattgtcataaatgacgcctccaataattgtttggactggaacaatttgttctttcgctatccgtgtaaccccattggaatctttcagttctttttcattttcgacaatctcaaagatcgtcaaatcggcatcaaaaccaacagtcaattgacctttcttcgccaagtggaagtttttggcaggaactgaggtgactttctcaataatctcttcccacgagtagcctactactctcattttttccagcgtagtagccagatcaaagactggaccattcgtacgattgcggatataaatatctgtactgatcgagttggctttgagacctgcttttaaggcagtttcagcaacgtggaaattaaagctgtctgttccatgaccgatatcaaagacaacgccttttttatacgcatcccaaacaaagtctttgatttgatccgtggcttggtctaaaatgccgttcggttttccattaaaacaatgggtcaatacgtcgcctttttccattcttgtcaatacttcttctaattcaggaggcgccgaaccaatatgaaccatcaatggcaagtcattgttttctgattggatttttttggctaactctagtggcgtgatgccattctcgccgacaactgttttgctcattcttgccttgatccctacaataaattccggaagctctgctaatgcagctctgactagatcttcttggatttttgtcaggtcagcaagttcatcttgttccacgatcccccatttagaaatgttcattagtgcgtacacattggttttgaccgatttcgtcagttgataaaaatcgcgaatattttctgcgcccgtagtccctgcatcaataaccgttgttactcccttttggacccctatttgatccggataatcataataaagattcatcttttcataacagtgaacgtggtcatcgatccaaccggcagagagataggaattgccggatagatcaatcacttctcgtgctggctcattgatttcggcagcaactgctttgattacgcctttttccaacgcaacttccactttcctgccgtcgattaatttgccatttttgattaaagtatcaaacatttcattgccttctttctattgaattaccgctgggaagatcgcacctaagatcattgcgcctagaatagcaccaccggcaattggttttttccaagcataaaaagccaacgcgcctaatgtcgccccaataccaatgggaatagaggccgcacaagcactcaaaatgatcaatgggcccaaaaatcggccggaggaattgccggcgcccatcatgacatccgcaccaaaagttgaatttgactgattgatggtgaatttgcggatcaacacgataatgccgccaacgatcagacccaagaccaacccagtcaataacgagagggcaaaattatcgattggtgctgttatcttcatgcttaggagaatggctggaacgccaatcccgatcccagtcaaaatcgaaccgcctaagtccaagatccctaccaaagagccttctaagatccgagcaaataagaaactcgccccaaaagctgccgcagccccataggaaccgccatccaagccggcttttagcatcgcaacgatcgaaacttcattgaatgcaccgacgccatacacgacatacatatgggttcctgagaatacagccgctgacatgattcctacgatcaatgggaaagaccagtctgcaaaccaaaaactcttttgccgttttgcttctactgcttttacctgttcttctgtctccatgatttccctcctatttcacactaaagatgttgtgcaagttatcaagccaatgaggtacttgaagttggaaactcttgatcatttccatatcaaatccacggaaaaatccgctgaaaacaaagagtaaaacaatcgcaatcatcatactcttcgtgacccgattccaaccactctcatcgacgcctttaccgattaagattcctagaacaacgccaggaaccgcattgcccatgatcagttgcgcaatcccgccaaaaagcgtcccccagaaacctgttcgtttccctgcatctaaagccgccaaccagaagatcactggcatcacggtattgatcagaatcgtcgctgccggtaccaacacggaaacagcggttacttgtaacgcctctggaatcgctgcagctgtcgtattcaagaaagcgactactaacgcgccaataacagcgccaatgatccccatttttttcggatcatgcattgtctggctgacatctttgtttttggctaagagagccgcagctgcccagttaggcacgatgcggtgggtcacatcttgcgtgaaagctccagcgccaactgaagaagcccaagcattaaagaaaaaacctaatccaaaggaaaaatgggaggcagcatcccccatgcaggcattcatctcccctaatgttctaaaagctcctaatccttgcgtactgggtgcatgaaacatacgagctgctccaacagatgcagagaaaccgagtaagcccccgatgatgatcgatttagttaaaataatgacaaaatccacgttattccctcctccttatgattcaaatcaaacttttttcgttacaaacggtaaaacaatcccattggggtcttctgttaggtgttgagtgaatggtacgtctgccaaacgtatttctgtcacagttaccgtgacagaaagttcgacttcataattcactcgttgccggggaaaaaagaagaatagaaagcgttctgtgtatttgttttcgaccgccttcaacacctccacattgattggttcgatgcgcaataatactttcgccgatgccattagtttgttttggatctctgcgagtgctgatgcaaaggcatgttgcttagtttctcctttaccggagacgatgactttttgctgagttgtcttttgaacgctcatctcgtatgccctctttctattttccgtgctttttgataaattcttccgtcaaccgtttccctaattcctcttgatccataaaaccgaaacctagcacggttttcccatctttgatggcggtgatcccttcttcaatcgaacgcatcccatgacgttctggatacccatatttatttgcggctgttaaggctccagccccaccgctcccgcaaaaagaaattcccatatcggcattctcttgttgcatgacatcacctaaacgcatatctgcgcccattcccggaacaacaactgccttgccgccagctgcttctacacctttagctacgttttgtccttttcccatacgatctgcaataactactgtaatcatgattgtttcctcccaaatattaattattttttgctgtttcaaaatgaatcgataaaacatacatctcatcttcacctaaatcaccaatcgttcgaacgacctcgtcggaaatcgcaatggcttctttggatacttctcggaacaattcccgatcaacagcgggaatcttttctcctttttgagagcgtttcagcatctcattcaagtgattgatcagaatcgtccactgaagttcagtaggttcaatggcatattccgcaagtcgctcttcgactaaagcaatcacttgttttaatttttcctggttttgactttcctcgatcatagttatcgcttctgctgacagtttcactagcttgacgctccttcttttatatatgaaaataatgcgctgatttctgatttgttgatgcctaaattattttcagcaaaaattgcttcaatttctcctaccaacgcttctcggttcaaaatgatttggtcgacttggctgccttctgctaaatattgctgatcaaatgtgatgcgatggaccatcaagaaaacatgaagcaaaaaggcttctcggtattcttggatcaattcagactctaatgtgacaagtaactgttcatagatcgtatatgcctttaaaatcagttccttgctgaagtcttccagagtccccttattgataggtgcttcattgagaactaattggtgccgcctatcctgacttgttgaagcgaggatttttttgatcatctgctggatgttttgcagatcctgctcagtcggcagtggatggactttgatgaaaggccgatcaatgccattgatcggaaaaatactaatgactagatccggatccttcgcggcaatcacctcttgtgcatttaagactgaagcaaaagccacaatagtaatattgttcaattcttcgttgatcttttgcttaattaaactcgtcacacctaaacccgttgaacaaacgtaaaccgctcgaacacttcgcaagtcttcttctctttcgtaggaaaccagaaagtgcaacgcaatgtaggcaacaaaagaatcattgatcaagagtttctcgtttatttcttggagtgctgcttgattgatagcagcaaacaattcaggatatttctgtttgatgtcctctttaaacggattgtactcattgacaaaatttttccttcttgagagacgcatagacaaatgggcgtagagattcgtcaataattgagggtcttgataaaacggaaaattgattttcttgcttaccttataaattatattctctaccaatttcatgacatcttgctgatggatcgtatcaaaggtatcactataaatatagtcatactcatcttcaaacaagggcaattgatagtaatcaaacacctgctgcatcacacgatacgaaagatcatgtttgtctatttcgtgttcccggatcaattggtaccgtccaatcgtggattctttgcgcaagcgaacagtggcaatcgctacacggatcaggatatttagtagttccgcataatttagtttttccagattttcagattctagtaagtacctcatccgaatgatgacttgattaaagacctcctgcaacggtgttgccttcgcagaatacatttcgaagcattccgtttctctgccatttagcaataaagccattaatttataaatgtcatagtctgtaaactctttttgcaaaatctcctcgatcgttaatcgtactaggcgttccttgccagtgatccaaaatccctttcgtgtctggcgattcagaactaagccttctttgagataatggtattccaactcatccaaatcattcatgatcgtatctttacttacttctagcgcattggccagctttagagccgtgatcgcttccttggtaacaagaagcatgattaacaggcgattgatccgtaagccttgatcggcaaacagctccagacgattgacatccatcaattcgctttttagtttgattcgatcagaatcactcacacttagccaaataccctggctccgtttgctgtgcagttcttgattccgctcaatcaaccaatcacggatatcctccagatcatatttgatcgttcgtacactgacactttctttttcagctaactgtttgatcgttaccggttctgtcatttctaacaagtaaatcaaaagttggctttctcttttggtaagctgctgcatcgttctcgctccttacaccgctaaatataagcgttttcttaactagtcacaatatgaaatgtttgcacttaacttagtgcaaatgatcgtaatttaacaactcatcaacttattcacaagcttatcccccctcaaaaccgcaacgtggacccattaattattgcactaagtcgtccctttacaacatctcgatgccattttttctgctttttttattttatgacactaatccaactgacagatacccttcacctcaatgtatcagaaatcgattccccgcatgacatcattgaacagcaaaaaacactttccaacttttggaaagtgccaggaaataggatatgaacgtgttcgttttctcgactgattgttatttaatcaggtgattatgcatcaatgaaaccgttagacatatccatcttgattaactttgaacagctatttattgaatcaggagaagaaacagttcaagatcaatacacttgagaaccaatgaaaactcactaatgctatgccatttgtcattaaaactacttccatttgtactcgcctacttcatttcaaactctttgccgaattttattagatacattttttctaaagtgtcctctaacaaatacaacttcctaggggagataaatgcattcttccagtcccaattcaccaaatcatactttccaatgtcagccatcgctcttacttcttcaatcgataagttcaattcttttcttagttcatcgattttttggatttgtttttttcttctgagagccgttggtacgtttatcgaagaaatgaccaccataaaccctaaaaaagaggtccattcataataaaagtcaaataccttacatacaaataacagaaacaagcctaacaagaaaaaaataatcgaatacaaccaatcgatcttttcattagctaccatctttttcacgttgatagcctccctcctaattaccttcaagacaaacaataaaaaaagaaagcaactcgcttgatttcagccgctcccagctatattttactatggttctgattgactgttcgttaaatatttttcactattcttctatttttttcaaccttaaccgcaacacaagatacatcatacctccaaaaaagcaacctccgagaatggaagcaatgatcctgtctggtgaaacgatgtacggaaggaaatcttcttcatccaacatcatactaagtactccattcaataagtgaatcgcaattgcaaagtagatacctagtccaattcctttaagaatcgtcttcttcttttcttttgccatctctttggcttctacttcgttttctgtcaattttaagcgtgccgtggcaaacagaacataaccgcaaacgataaagactgtaaagaatatattacagccaataaaaatccataacgccagctctggtttcttagatgcaaaaaccgttaccagtaaattagcaaccagcgtatacccaaacatcagcataaacgcattattgccaatatgttctacttggctttttttgtattcatctaagacaccagaaataccataaaaccgcttgattatttttactgccaatccttctttagccttcatcactttcaacctcccaaaacaaagaatttaaatccgtttgcagtactttagcaagcttaatacataaatcaagagaaggattatacttattattttcaatcaaattgatcgtttgtcttgccaccccaatctctttagctaaagcattctgagataaattcatcttctgtcgaaattctcggactctattcattcttttctcctatttagtcatatatatgtgacacaagcgtactacttatctctttttctgtcaaatatatatgacatattaccaagctagtgtaaactcccagcaatcgatctcacaagctttgtagagagtataaaatttataatccatatcagcaaatctaggctagaagtacgtaaaaaagacccttccaatggaacagaccatcattacctaagataactattctagtagaatggaataagctttgcatgttccacattctgtaaccagcatctttcgttgaggagacgatacgctaaaaacttctttcttaatcctctcatcatagaactcttcttttttctcgaatcactttttgctatactaattgaacatatcgaaatttttattgtttatggaggaaccatgcaaaaatttattggaaacaaagctttttacaggactgttttaacgatcgccattccgatcatgatccaaaatgccatcactaattttgtcggtttattagacaatttaatggtaggacaaatcggaacggcccaaatgtctggcgtggcgatcgttaaccaactaattttcgtttttaacttaagtatctttggcattgtttctgccggtagtatttttggtacccaattttatgggaaaaaggattatcaagggatgcgagatgcctttcgtttcaagctagcgggcaatcttttgatttgtttgttggcgatggggctgctgtttttttgccaagattttttgattcgcttatatttacacggtaccggtgacagtgcagaactgacacttgctttgacgtctgccaaagaatttctagtcattcttttgtttagtctgccgttttttgctatttctcaagcttatgccagttctttacgcgaaatgggcaaaaccatggtaccgatgtttgccagcagtatcgctgtcgtcacgaacacagcattgaatttcttattgatttttggtttgtttttcttccccactttaggggtgcgaggtgccgcgatctccacattgattgcccgcatcgtcgaatgtgctatcacgatgtattgggtacatcgccatgaggaagagaatccgtttgccattcgggtctaccatcaattccatgtccctttgcatttggtgaaacagattctgcgtaaaggatcgccattgatggcaaatgaaatcctttgggcgatcgggcagacaatgattattcaagcttattctgttcgaggactatcagtgattgcttccttgaacatctcatccaccgtctccaatttgttcaatattgtctatatggcccttggcggtgccgttgcggtcatggtagggcaacttcttggagccgctaaatttgaagaagccaaagacagcgcccggaagctgcttttcttttccgtcatgagttgtcttgtacttggtcttttgatgatcctagtcgcaccattctttccagaaatttatcaaaccgaacccgaagtcaaacatctggcgagtcaattcatcaaagtcgccgcactgtgtatgcctatgtacgcctttaatcatgccagctattttattttacgttcaggtgggcaaaccttgatcaccttcttatttgacagtgtctttacctgggtgatcgtcttgcctctagcctttgtattaagcactcacaccagtctttcgattgtcttagtctacttgttctgccaactagcagagctgatcaagagtgggattgggtatcgtttgattcgatccgatctttgggtgaagaatattgtgcattgaggaaaagtttcaacataggggatgaaaaagatggatagtctggtggaaatgagtgattttttatcctaaaaataaataagacattcctaaaaccgattgtgattttgggaacgtcttatttattaagattatatttattcttttgaccattgaaaatatagacatttcatacaaaaactgttttcaaaaaatggtagctttactaaaaatgactccgcaaaatgatcatagtaattttttgctattattgaaataatttttttccagtccaacttgaaatttcgtaactttgtaaagtttttggaatcttactgtaattcaaataagtagcattttcgtaccaaccatctgccactacaataaagtttgcttgtgccccattcatagtgcccgataatgccccttgggtaaataccgtatgtcctccaatacttccgttaggtttatagtaaaaataagtaaatgctactggataactctgtgcaattttcgtttgatatccgaaaacgaaggagacacttttctctgatatgttaaactaacacttttatcttttgcgtattttactagtgctggtccaatttggtcaggttgtgtccctccataagagattccattattggttgaagatacggtagttcctgaatagttccacaatgaattgtatgccacctttaattccgaatcatttccagaattaaagaatctataggaagaacttatagttgctaatgcatgtactgcacaagcgtatttcccagtggctttttcagatctactctgggatagcgcattaaacattgctaaataatgtgcacttgtcaagtgtaaattacttggataattactaaataccgcgcttgcatggtcatactttgtagaacgagaattatatctagaaaagtgttctatttccatttcagcaacaggctgtacttcttctacatacttttcaaattcatttagtgaaaagttctcaccgttggtactgatgactgaatctttgtcttctacaactaaattatattcagtgggaaaagtctcaattaaataagattcctcagtattatcaactttcatttgtgatttatctgctaaaaatcatataaactttttgatccaagttctatagaaaattgagcaatataagtaccttccattcttaaatcaattataacgtaaccgtgtgtcacaccctctttaataaaatctacactataagaaataattttttcttctgtatcataaataggaattatagaagaaacaaccaaatcttcagttcctttaaattcttttgcaaagtttaaagctaaattggctaagctttcatcagttatttcaacagcagactgttcagaataattttcactgatgtctgcttctgaaatggaaacttcttttgcattagtactcttctctgtatatagaaacacaaaacaacttgttaccattacccataaaattctactgattttcttcatttttaactactctctttgtttgccaaccagcgcaaccatagaacacaatgtattattcattccacttaaaaccatattctatgaccaacattttttcacttcatttacctagcatttacaaattttatgacagtttaaaacattcagtagagcttaattgcttcgagagtgtaaaatattttgtgtaaatagaaaaaaggaagtcccttctgtagaatagagttaccacaacacattcacagaagagaggacttccctatgaacgattttactacagaaattctaaagactctagcgaacaaaggcgatttgaatgaattattccgtgtccatttggagaaagcagtcaatacgcttctcaaaacggagttaacggctttcctagattacgaaaagtatgatcgcattggttttaacacgggtaattctcgtaacggctcctatgaccgtacggtcaagaccgagtatggggaacttcatctccagattccgcgcgaccgcaatggtgagttcaagcaacagactgttcctgcttatagacggacgaatgacacgttagaggagaccgtcattcacctcttccgaaaaggtattaccatgtcggaaatcgcagacttgattgagaaaatgtatgggcattactacacgccccaaaccatgtccaatataacaaaatcatttacagaagaggtaacggcgtttaaagggcgggagcttcatgaccgttatgctgctatttatatggacgcaacgtatattccgttaaagcggaaaaccgtcgccaaggaagctattcatatcgcagttggcatttgcccggacggatcaaaggaagtattgagctatgcgattgcaccgactgaatccatcacgatttgggaggaaattttattggaccttcaagagcgcggtttgaaaaatgtcctcctgttcatcacggatggcttaaaggggatggtaggagcgattagtcggttctatcccagagctcgttttcaacattgttgtgtacacgtttcccgtaatatcagtcacaaagtgcgtgtcgatgatcgtaaggaagtctgtgatgattttaaaatggtgtatcaagcctcatctaaagaggtggcgttggaagcacgtggtgcttttgcggaaaaaaggaaaaccagctatccaaaagtggttgaatcgattctttcgaacgatcacttgctcactttctatgatttccccttggccatacgcaagagtatttattctacgaacttgattgaatcctttaataagcaaatcaagaaatacagccaccgcaaggaacagttccaaaacgaagagtcgatggaacgtttcttagtctcgtcttttgatacttacaaccaaaaattcctaggtcgcagtcataaaggctttcaacaggctgaaggcgaacttgaacaaatgctaagccaactgattgagaattagaaacaatctgcagtagggaagaatcatttacacaaaattattgacgctcccggtaccggtggtgggaagacatatttcattcttacaattattgaagccctactacgaacaaaagctaaattatttattttagaccccaaaaatgcagatttagctgatttaggtacagttatggaaaatgtctattacaagaaagaagatatttctgaatgtatagatgatttctacaatcgaatgattaatagaagtttagagatgaaaaaaatgtccaattataaaacaggagaaaattatgcttatttaaaacttactcgatttcacttttaatacgaccacctcccataaataatatttaaatttatggaaaggaagatggtctatgaatacactgaaagaagattttattttagcaaaagctggaaatgaagaagccattgaagccattcttaaaagattcagctcgttgatgcacaaaaaatcgtggagaaacggaaaatacgatcaagattgttatcaagaatgtatgattgcagtctatctagcaatttcaaaatttgaaatcaaggaataagctcattttggggagatgcattttgcttctccctttcttcttatctacctcaccttatccattaaatttttcaattcagttacatttgttaactcgattatattaggaattggctgctttattagattattcctagtgagttttgttaaatatctactaagtgtttctggagtcatccctaaataagaagcaagttcttttttcgtagtttccaattttatctgctctgtattttgctttatattttcttctaacaaatactgaattaagcgtgtttctgctctttcagtcgtgattcctacagttaatcgttctgtattatcaagacgtctcgccatttctgataaaagttctagagctatttggggatgcgatagtaaaatccgcttaaagttgtccttttgaatggtacatactttagttggtgatattgcttctataaagcatccataatgttgttcttcaaataatgccagctcgcccacaaaatcaccctgttctaaaatacgaatcacctgttctttacctgaagaacctaagcgataaacttttacttttccttcttgaataagataaagagattcaagtatatcttctgcttgatagataaactgtcctgcagaaaaagcttgttctgtaatatcactttggataaattgaatttcagtgagggacaatccctgaaataaaggcattgtacttatacaatgatcatattttgtgaaatcaatcatgttcttactactcctctttttgtggttagtatagcataaaaaaacgttcactcatgtaatatcatcagtgaacgattttctatacttatttttctttatctgcatcataaagaacagcgcgtactgaaacttcaatggaatcctttactgctttagaatatggacaaactttatgcgcttcttcagcaattttttgaacttcttctaaatctaaatcttgaattgcaacttgaatctcaacacttaatttaaagtccacatcgtctggctttttgtataattttactgtatgtgtaacttgtgaagattgatgaattttacgttgacccttaacaatttctaatgccccgtgaaaacaagcactgtatcctaaagcaaataattgttctgggtttactccactcccagatcctcccatttctttaggtgtagaaatcttcacttcaaatgatccatcatttaaatagctcactccatcacggccaccggtattagtcgctgttgtttcgtaaatttttttgtaatctgacatattgaagtcactccttttcacttttatggtcctattttaggaaataaagttggtgttggcattgatctaaatcaagaatcataaagttaagaataactttatgaaaaaatatcgttggatgcagtatatctctttacttgaactttattagctatgtttattggtctttttgttaaggtaaataaatattaacaaagctattattgcgcctccaaaagaaccacctatcgcaataaacacatccactgttccttgaattcgaatgatatttgatttagttataaaatggatgaactatgatataattttttgctttaggtttccttcagattccatcagctacaaagttgctacccgtgcagggtacatcaaaaaaggaaatgccaaagcatttcctaaagtgtgatttggtcaaaacaacaccatttgacaaagcactgaagaaactagaatgacttttcatcaataaaccctattgttcgttcagattttccatttactccaacacaaaggagtttttgaaaacaaattcactcctccctcctaaatcttcttaaaaaccattattctccgccaatgtcttaaaccattccccagatttcttaatcgtcttaatctgagtgtgaatatcattagcgattaagccgtagcggttacggtaggcattgctccaggaccagcaatcgataggagtccatagatggtagccaaagcagttggaaccttcttcaatccctttatgcaaccattggagatgctctttgataaattctatgcggtaatcgtctagaatttgccctttttcatccataaagcgttcttcccgagaaacccccatgccattttcagaaacaaaccaaggtagattgccataattatcgcgaatattgatggcaatgtcatacactgctttgggatagatttcccaacctttgtcaatattcatgcgacggccaggcatttgatatgcatcataataacgatcaggcatccaggcacccactgaatttggagcaatgtcaggtgtcttgacccggtttggatgatagaaattcactccgataaaatcaacagtattttccttaatcaaagctaactcatcagcagttgactgccacaataccccatccttagtcagcaattctagcaattccacaggaaattcccctttgatggctgggtcgagaaacattttattgttccacagttcggcaattcgggctgcctcttgatctgcttcagcatctgaagctgcgtaagttggcgtcaagtttaacacggtaccaatccggccaccagcttgtggttgacccatttcgcgaaacttcgccatgaccttagcggaagcgagatttaaattgtatgccacttgtactgctttcttgccatccaccaattttggataatgaaattggaacaagtactccccatctactaccaccatcggctcattgtgggtcacccagtctttcacacggtcaccaaacaaagcaaaacattgttcagcaaatcccacaaacaaatcgacaactttcttcgattcccaaccgccatatttatggtaaagctccactggcaaatcaaaatgatggaggttaaaaatcggtcggatattttgagagaggaactcatcaatcacattattgtaaaaagcaacacccactggatccacttcattggtttccaaatccttgatgagacgggtccattgaatcgaggtgcgaagggaattcaatcccgtttgcttcatcaatgcgatatcttctcggtagctattgtaaaagttcgaagccatatctggccccactcggtcataaaaaacttcaggttcaatatcgtaccaatgatcaaacatattggcatgtttcttttgaaaacggccttctgattggggaccagatgtggctgcaccccaccagaaatcttttggaaatgtcaacatagcattctactccttttctctcaaaacgtcggctaaacactgccgcatatgatcgccaaattttggcaagtattcatggccatactctggataaaatagcatttctttgtcagctgcgctacttagctgattgtacacagcaaactgggttttcggtggacagactgtatctgcaaggccaattgcccaatgcaccttccctttgatccaaggagcaaagtattgcaaatcaatgtaatccaatgtttcaaagaaagcttcttctcgttggtgcaaggggtctttaaagcgaaaccaataagccaactcttcataggcggagttttctacatctaagcgataagcttcgcgataatcacttaggaacggataacaaacaaaagattccttgatttccggagcaacagccgcacaaatcaacgccaaagctcctccttgtgacgcaccataggtatacagttggctggtatccacttggggttctgctaccattagccgagtcaactggtaaatatcgagaaacacacttcgataaaataaatcatttggtccagactccactccccggattatatgccctttcagactggttttcgtggtcaatcccacatcttctgacaaaccaccttgtcctctaacatcgagtgccactacccaaaagccttcagcagccatagcgaccttgtctgaccaatccccagcatctgagtgatacccatgaaattgaagcaagaggggagactttttttgcagacgtttaggccgaatgagttgacaatggacggtggctccttgaacacctgtaaaagttaaatcaaatgcttctgctactgaagaattcaagggatgaggctctaaatgatagtctgtccccaaatcatctacctcttgaaaccctgcctgccaaaaagcttcaaaatcagcaggctctcgctgactcccttgatagttttgccaccttttttttgcatctattgcatacattaaacttgctcctttcgtaagtgatagtttgccactgctcctatcagattagcatcttgttgaaactgacaaatcttcacagtaattcgttggtcctctgaatgatgatgttgttgtaacaaacataattgggcttttaccggagccaatagatctttgcgcattgatatgccaccaccgatacagactacttcaggatcgatgaccaagcaaacattataaataccaatcgccaaggctcggaacaattgttgaacttcttgttgagccaattgatctccagtgtcagcaatatcaaatagttctcgacctgtaatacctgataccaaacctttctgttcgcaatagcgctttgcagcatgaacagggctggctaactcacttaacgtttgtccattttccgccaacatgtagccaaattcgcctccaaataagttatgccccttgactagtttccgctccaacaccacggctccaccgattcccgatccaatgatgaaagaaactgaacttttggcatctttggcagcaccataaaaggcttctgctaaccctgcacaattggcatcattttccacgaagacaggtttttccaataactcctctaattctgcaacaaaatgaattttatgaatataggggatcgcactgtagcccccgataatcccctgatcactgtccactgctccgggtacactgatcgacaccgcttcaatcggtgtctgactacaactggttaaattatgcaaagtggcttttaggtccatcttcatttgctcccaagtcacgggtgtcacaaaggaacctttttcggtcaaggcttctgctgcccacagagcatatttgatactcgtacccccaatatcaattgctaaaatactcaagaattccccctactttctcagtctacttacctacactaattttcattgtaagtagttatttatttttaggtatatacttttaaaatttgaaaatcaaaataaaaagcggaaagaggatttttccgcttacttattctctcgttaagacaaactccaccgaaaaactatcataacgatgaactgaaatggagtactcaaaagcgatgcctgtatcaaaataagcaatttgctctgccactgccaccggatctcccgaatccaattctagatactgttgttcgatttcagtcgcctttcggacactgacgcgtcgatgcccactttggattttcaaaccgagatcttcttcaatatattcataaatggacccttcaatattggcttttttcaaaccaggaatcaaatcgataggcatgtacattttttccataaccaacggcttgccatcaatgtgacgcacccgataaatatcatacacgaaagtatcttcctgcatatttaatttattttttaccaagttatccgcttctattaccttaaactccaaaactttacttttaacttcttttcctggattgagagcagtcgtcccacgaaactgattagccaccgcaattcgttctatttcatcggtcgccaaatccttgacaaaagtaccggatccacgacgtttgataatcaatccctctgacactaacatatctaaggcctttttcaccgtcatcttactagcgtcatattccacacaaagatctctttcgaagggaatttgttgatttgcttgatatacaccttccagtatcttcttacggatatcactggaaataaggatatattttttcatcgtcatgttacctccacttatggcttatcctaatatcttatcctatctgctaccgaatggaaatagccagccactgtccttttgaaattatttatctactcgtcgtaaatgatacagttgagacgcataatcccccggcaattgacgggaccaatagtcttttgctcgaccgacatagttgccacccataatcaagccaatgctagaaagatccttaccggaacgtaattgtggcagttgattgatttgataattagcttccaaatctaaaccggccaataataaacgacgataagccggattcggtttacccaacacttgataatccgccaccaaagcttcactcaaatcttttgaaactaccatccaactacactgggtattatcaaaaggactattgagacgataaaaacgcccctcgtggatcaattctcggtattctttaaaggtggcaatcgctgcttttacctgttgtagctctacatctgacatcctcgtaatatccaactccaaaccataagtaccaaacatcgctacctgattacgaaaagtcagtcctggcgaacgccctacttgatgattgggaatctgtgacaaatgactaccgatactagctaatgggtaaaccatcgaagccccgtattgaattttcaagcgttcgaccccatcagtatcatcactggcccaagtctggggcgcatagtagagtaacccaggatcaaaacggccaccgccaccagcgcaggattcaatcaacaaatcggggtattttgctaagattttttcatacaggtcataaacacctaaaatgtagcgatggaacaactctccttgattaccatcggcgaggtaattggaaaatggttctgaaatataacgattcatatcccatttcaggtatgtaattttgccacaagcaagaacgcaatcgatttgctggaaaattgtctccaccacttctgggttgctaaaatccaagacaaactgattccgtccatgagagatttgcttctcagaattaccaattacccactcagggtgcatctcatacaagggtgtatccgtagaaatcatttcgggttcaaaccacagcccaaattccaaacctaattgattgattttcgtcgcaaaggcagagatcccctctggtattttggctagctgcacctgccaattacctaaagagccgttatcactattccgagtaccaaaccagccgtcatccaacacaaacagatccacaccgattgctgctgctttttcagcgatttgtaataatttctcactgtcaaaatcaaaataagtggcttcccaattgttgattaaaacaggtcgttgcttatgagaccagcgaggtgatatcaagtgctcttggaaaaaatgatggaagctttgactcataccattaaaaccggcctcactatacaccagtactgcttccggtgtcaaaaatgtgctttttggagttaattgccaagcaaattcaaaaggattgatacccatttgaattcgcaaaatgtcataagtatccagctgcaaacgtgccacaaaattgccactataaattaagctaaagccatagatctttccttgttcttccgtcgcattggactcacaaacagccataaaaggattgtggacatgactgctggctccacgagtactggcgacttcttgcacaccataagcaatggaatttctactaatctgggtttctctcgcccaagctccatccaagtgtagccaatcatagtgctgatttggaagatccagattaaaactcagacagtccaataactcaaaggtcgtctcactaggattgatgatcttcatttgtctggtcactacagattcttcaccaaacaaggtatagtaaagctcgacttgcaaaggtgaataacgatcttgcaaggtgataattaaagtctcccccgcttcaccaaaactgccaggcaagccagaaagtgcctgttttcctaattcaatccgatagtgttgataggtaaagtgactaatacgatctccttttggatagcgtacccgtagcatgggatagcgaaaatcagtggtaccatagaggcccacttcttgtttgatatgttccaacgaagtagtgtagttttgcttgatttggttgttagcgggacgtatttctctttcaatcaaaaaatcatattgatcataaataggaatactacttccaaaatagagttgttccaagacgtctaactcttccattacccgaaaaatataactaatgttctgattttttaggtgaaactctcttctttcaggattgacactaatcatgatttattccttccatttcacgaaatttttgcgagccttttttcagtaaataggccactccgccaggagccaccaagaaaaacagcaagggactgaccagcaataataggatccaaaaggcataggtccccaagatgaagccatttagcaaactgggtcgtaatgtctgaagtaatagctgatacccaatagcaacaggagcttccttcatttcgtcatacgtcgctgttcccaagacccagtgtgcattatagagtaagaaaagaagcaaagataatcccccagtaactttaaaaaacaagcctagtgaagtgctaccgagccacgcaccagataaaaagatcgccaaggacaaaaatacgcccacagatagcactttttcgcacagtttcgtaggtggtagcttcttggttagtcgacagagcttttcttgtaaggcttctggatggtcgacacaaaaaactaactttttatggctactaacccagccataaataaagccaccagtgactaaccagccccaaaaatgcaaggaacactttactaggacatagagtaattccactgcaactactaatttactggacttctcggtcaccagtaaccctccttttccggtaagcttatttcacagaaccagcaacaccattgtaaatgtatttttgcaaagccaagaagacaaccaaaatcggtaaaataacaataattaccccggctaagatcactggccagttggttccataagggcctttgaatgcaaagagtgccgtggagatcacttttagtttacgatcgggcatatacaagaatggattatagaaatcattgtaaacacccacaccgctgatgattagcatagtgacaataggtgcctttaagttcggtaaaataatccgccaaaagataccaaaatagttggccccgtccaaataggccgattcgtctagagagactgggatttcatctaagtattgcaaaaaaacatagatggaaatcacatctgttcccaaatttagtaaaataactgaccaaatcgtgttgaacaagccaattccttcaatgatttggaacgtcgctacttgactagtaatgccaggaatcaacattgccatcataaacaaagctataatcggctttttcagtttaaaatcaaaacggctcataacataggcaaacatcgagcctaacaaaagcttacctaccatactaattgaaaaaataagcaacgtatttttaaaacctgtcaacatctgaccattgataaacgcagttttgtaattactaaagtccaatgactttggtagcgacaagacactggtagacaaaaattcattattggatttgaaagagccaataaaaactaccaggattggtagtacggcaaccactgccccgataatcaaaatcaaatattgaagtatacgtccgatagaaaattgtcttttcatcttctatgcctccttctcgctaataaatttccgttgaatcaacgtcaccactaagacaatcacgagtaaaataactgccatcgctgaagctaaaccaactttattatacttaaaggcagtatcgatggtttggattacaaaggtcatggtgccgttggatcctccagtcataatatatggaatatcaaagacactcaaggagccgcttatgcccaaaatcagatttaggaagatgattttgcgaatacttggtacgatgatataacgaaactcatcccaacgattagccccatctatttcggctgcttcataaacttctggattgaccgactggattgctcctaaaaaaatcaaaaagttaaagccggtataacgccacaaggaagtaaaggccaaagaaatattattgatggagcgatctcctaaccatagccgaatttgactctccaaacctagcgccgatagcactgtatccaaagttccatcacctttaaagaagtacaagaaaataaatccaattgctaccccatttagtaaataagggaaaaacaaaatccccttccaaaaattagcaaatttgaccttaaaggacaaaatcgttgcaaacaataaagcgacacccaattgcaaaaaagttgcaaagaagtaatacaagctggttttaaaaacggtaaagtattttggattggttaagactgtcttgtagttatctagtccgacaaatttactgtctggggaataaccattccactctgtcaaactgtactggaacatcttcactaaaggataataagataacattaataataaaaataccggaataatggtaaaagtaaagatcaagattcttttttcagttttttggctaaaacgggattttttcaccgtcttattcatggtaaactctccctgtttattcatgttggctcctccttattctaaaacccctcatatcgaccacggtccgcaatcgctatgtactcctgcaaaagaagttactaccaagataagttttctttacgacactgtgcttttgcctggcacaagttgccagacaaaagttagtgcctacaatcaaaactttatttgctatcaatcaaaagtcttttcctaactgctagggtgacttctaaaaaaattttactctcccacttctgctatcgcatctgaccagcgtgtattgaagtctttcataatagcttcgaagctttcgttagagttaccaactgctgcatcgatgattcgttgcttttcagcatctgtcgtacccaaacctagttcagattggtcattgattgaactaaacaatgattcttttccggctggtgctggattttcttcaattaactcaaccccagcatcttgtgcagccttcaatgattctggataatctgctccaatttttgctgacaagcccccgttttcttccgcgtagtctgattcattgactaaccagtcgatcaacttgcgcgccgcttctttgtgcttactatgaacgttgatcccatagttataatctgctccaattggcaaatattgtttaccatcctcggcagtcattggaaatggttggaagataatgtcctcagcagtatcagcattgatgtctttgatttgtggtaccgcccaacttcccaaaaccatgatcccaatcttaccattagccatatctacttttgattgttcccaatcagatgtagttgggtcagcctcaatcaacccttgattgctaacatcgtatagggttttataaatcgtattcatcactttacccgctgcaaatggctctttgtctgaagtcatcttattggtaaagtctttatcaccagaagcaccactgcgaacaaagtcccagtttgataatgtccaaccagccgcatagttagtatatagcggcatcacatcagtatttttttctttgattgtttttaatgctgctacaaaatcttctggtgtttgtggaaattcgtcaataccagcatctttgaagaccttttgattgaccaccatcccagtggcgttcatctgtgacggtaagccataactcgtgccatcataggaccgatcatttaaacccatatactctttgctgagctcttcctttttaccaagtggttcaaaaaagttcccataatcttctggcttgatatctcctggaatcatcaaaacatccccatattcttcactattcatccgggttttaatttggccagcatagtctgtaatcgtttgaatttctactttgatatccgggtacttctcattgaattttgtcatgtattcatcccattttccattggtttcccagtcggttttgtggttgatgaaggtaatggtctcagttttcccaccatccttgtcattagctgaatctttgttgtttccacatgcccctagaactaaacctgctactcccaagacgatcattgaacctagcatttttttcttcatgttacttcctcctataaattaataaagtgctgttaccaaaaactgttcatggcctgttacgtcagaaatggaaaacgattacataaatataatactacattcccatttcaaagtatatacttttatatatattgttttgtacttttgtaaaattctcgaatgatcgccgcagccggtttaccgtaaaccccgtaatcgtcgtctttgagcgccacctctcgcgaatataaccgcgccttccagtcccaaataccaaagccttgaatccagtttctcttgtcacaagcagtaaacatcttttcaaaccatcgtgattgcgctatcatgctaacttcccctgaaaaactccaatcattgggtagatattgacttccttcacgacttggacaacccacttcacaaaagaagaaaggtttttggtagtgatttaccacttgttcaatccgatccaattcttgttcccatttgtcaatcggataatagcctgatgaagagatgacatctacagcatcccaccaagttagattattttcttgatacttgtcacaattataagttagtagaccattgtaatgctgtcgaatctgggaaatagtttcccgccactgagcttcccgtcgatcactattaaccaattcacagccgattaccaacatgacacaccctgtctcttcagcgagttttgcatagtgattcaggtattcacgataggaatcaaaccattggctccaagtcggctcgcagggaacatcgtaatcaaaaaaattgatgtgcgctcgccacgtaccatctgccacattgaccatgggtttcaagattactttcaacccgattccctgagcgtaagcgatcatccctttcacttctgcatctattaaaacgttgtcactttgccaatcgattttggtagactgaggatgagcttgtgtgacagtaattggtaatatcacatgacttgcagctaactcttctttcatcatgcgtaatgattctcgactcattggatcttgccagtctccccgttggctcataaacccaaaagttatcccattgatagtttccatcttttcacttctccacgttttattttgtaatcgatttcaattctatattataaaggacgaagaagaaaaaaaacaacaaaaatatatacttttgattataatgatttatacaatatgatatagtaaatataataaaattggaggtcttttttggataagaaaaaattgtacacgtagctcactcaaaaaatcatccccttctggcaaggtaagatggatctaattcatgatggtttttacggtcgtcgggataagatcccactactaataagagctgcttgatgaacgcccggtatttatggagttttagtcattgctgccgcattttacaagacaaatccttaactgagtcttttttagctagcctaaagactgctgcgaatcctgcctatgaatttttccggtaagtctgttgggaccaggaaaacccaggggatcttctgggagctaaccgcaactgaaatactctctgatcccaataaaaccacttatgctaatagttttgccctctatgttcttagcgagtattacttagactttcatgatctgtctgcattaaaaatggcaaccacgctctttagttttctcgaaaagaagtcttatgaccctcttacaaatggttatcaggaggatttttcccacaactggtagcccgttccctcccaatcaatcggacccagcgatttgccagatctagactttaccactaatacccatttgcactttttagaggcatatataaatttctacatgacgacgccaacattcgatgtaaaaactaccttgcaaagattactcattgtctttacagataagattgcgaccccagcaaactgcctccaatttttcaatgctgattggtgtcctctaagccaagaaatcagttttagccatgacattgaaaccatttgggtattgcaacggactttgactgttactagtatcaaagatgtgcaagtcagtcaatttattgaaaatcttggtactcaagtagctaccaaaggcttcgataacaacaaaatcatttgtgatcattcaaatacccttcaaacctcgactcgaaaaacttggtggacgctagcagaagcaatcatcggcttttacaacctgtatcaattaactaatagtaaggtctattatgaattggctactcaccacttcgaaatggtagaatgaaactttgtggatactcgatctaacagtgaatggtatgcctacctcatcaatgatggacaccagattctacagaagatatcgccaacgcttggaaaggccccttaccatacctgtcgtatgtacacagaaacaattgcacgcctatctaggtaagaaaaacaggacgacctgacttctagagaatcattcgaattgtagtgacatcgcaaaaagccaactaaagaacagttggctttttgatagtttattttagtaatttctgcttagatgcaaatatatgcgcaaatggttctttagctcttggttatccttaatactacaacctaattgattctctccagcaactccaccctatttttcataatttttgaattaaaataaaggtaatcccttttaattttctatctttatttcaatatcagaatttattattttaaatttttacatacctgtttatgaaaaactaaataatctgtcaaaaaaatatgattgttcatttctaaatatgttttccaattttaaaatcttttttagcatttttgtttccttttcatatggtttttcgttgttaatagtgactaggatgatattcctattttgaccattgacaattaaatataatttttgaataacgttccctgctattcgagctaagaattcaagtacgccatgacctatttagcgataactacttagagatttctttttgttttgggaagacaaaatgccatgacaatagcagtagataatgatacttccgtaaggctcgccgtaaactggggagaggtgaaattcctatgtgcttacccaaggcaattcaaaaattttagttcatttataaggggatgattttattaaatcaatagtctatctaaacaaaaaacaaacctgtgagtttttaggaattgataacaatactttagataaatggattcgtatatataattttcccgtaataaaaatagacggtataattcgctttgatgtagaagatatcaaaggctttatggatacgttcaaaaagatttgaattttacttttgactgcatatactaaaagtagcgaaatatactgccttacttttttattaaggagtgaggaagttgcctacgaagctttcaaatggaaaatataaaactaatttgagatatccaaaaaaatttaaagaaattacaggtatcagttcagaaaaattccaaaaaacatttccaactaggcaattggctattaaagccgaaaatgaaatgaaaaagaaaatcgcaaaagtcttaagagaggagaatgcaaattcattagagctcaaaggtcaaataaaattcaaggagttttataaatctaaatggcttcctagatatgagttagggcaaactactagatcccataaagctccaagcgatataaccatcattaatacaaagaatttatttcgattgcatattctgcctatatttggtgagtatgccatgagctatcttaatgcaaataccgaaataatatcagatgaactcacaaaaaagtcgaaggaatatgcaaacataaaaatcattaaatgctatgttcgttccatgtttgatattgcagaggttctaaattatattgaatttaatcgtacaacaaaaataattcaaagtattactgcacctaagaaagttgctctggaagaaaaaagaatacgagaaggaaaacaagctttatcttcgaaagaactcactgattggttagacactgtaagagatgatttcaatgatcaattactttcctttcacgattacactctttttatgcttactttatatcttggggatagaaagagtgagacctatgctttgcaatggaaatacattgattttgaaaaccaaacagtccgtcttaaatatgccttggataaacacacaaaaaagaaatttacaaaaggtcgaaaagatactattatccaagttccggaaattgtaatgacactattgcaagaatggaaatcagtgcaagctgaacaactattgaagttgaaaattaaacagacacctgaccaatatctttttagttactccaaaccttctggtgaagtaaattgtccagtccatactgattacttaaattatcgaattaattctataaaaaaaagacatcccatttggttcatttaactcctcataaacttcgacatacttacgcaactttagctagacaaggtggggctgatatgaatcaaatttctaacgctttgacacattcaggtatttcaactacaaaaatttatgtgaatacacctgatttagttgataaagctgtgttcgaagcgtttcagcgaggattacaaaaatctaattaatgtgttctagaatgtgttctaaatataaaaaaaagacactttccaaataattggaaagcgtcttgaacgttgatatataaaggatattaacgttttgaaaactgtgaagctttacgagctttcttaagacctggtttcttacgttcgaccatacgtgcgtcccgagtaagtaaaccagcgcgtttaagagctagacggaaatcaggatctacttgtagcaatgcacgtgcgataccgtgacggattgcacctgattgtccagcatatccaccaccatttacgtttacaaaaacatcatatgatcctttagtttctgtaacgccgaatggttggttgattacttcacgcaggtcagcgtgtggaatgtattcttcaacatcttttttgttaacagtaattttaccagtacctggtactaaacgtacgcgagctactgcatttttacgacggcctgtgccgatatattgagcttgtgccaatgaaattccctcctattagattaagtttgtgatgtccaatacttctggttgttgtgcagcatgtgggtgttcagcgccagcataaacatgaagtttcattccttgtttacgtcctaaagtgtttttaggaagcatgcctttaacagaagtttcgatcaaacgacgagaatttttagcacgtagttctcccgcagagactgatttcaatccgcctgggaagtttgagtgacggtaataaattttatcgcttgctttgttacctgttaatttgattttttctgcattaatgacgattacgaaatcacctgtatccacatgaggtgtgaatgttggtttatttttaccacgtaagatagatgccacaactgctgaaagacgtcccataggaacatccgttgcatctactacgtaccatttacgttctacttcgcctggtttggccatatatgttgtacgcacgatttttttcctccaattcaatttcacgaatgtttgacatacacttgagtttccggggctctcgtggggcaaacaataccatataacataataccgtcttaagcgccacatgtcaacgtgtttcgcagtttttttgaaatttcccttcaattcttttccgaaaactttcagttgttattctgaccaaacagcctgcacttttatacacattttgcgcataatttgtatacttcctgcaataagtatctctggtttttattattatatcaatctgtatctatatccttgctaaacacaagaagaattcattgtataaatatttactttttctcttgatttcttatttttattctgttacgatagcttcatcttacttgaacttaaggatgggagttaatcattatgaaagaaaaagtaattttagcgtattctggtggacttgatacgtctgtttccattaaatggctgacagatcaaggatatgatgtggtggcgtgctgtctggatattggcgaaggccgtgatacacaatcaatcaaagacaaagcactcgatgtgggtgccatcgaatcctatgcgattgatgcccgagaagagtttgcccaagactttgcattgattgccttacaagggaataccttctatgagaactcctatccgctggtctctgccctttctcgtccgctgattgccaagaaactagtagaattagccatcgctacaggggcgactaccgttgctcatggctgtactggtaaaggaaatgaccaagtccggttcgaggtcgcgattgccgcattagcccctcacttgaaagtcattgctccggttcgggaatggaaatggtcccgggaagaagagattgcctatgccgctgaaaaaggggtgccgattcctgccgatttggataacccttattcgattgatcaaaatctttggggccgggcttgcgaatgcggggtcttagaagatccatgggcgactccccctagaggcgcttatgccattacgcaagaattggaagatactcctgatgtaccgacgatcgttgagattacttttgatcaagggattcctaccgcattggatggcgaaacactgaatctggccgaattgattatgaaaatgaatcgtctagccggcgaacatggtattggtcggatcgaccacatcgaaaaccgtttagtgggaatcaaatctcgtgaagtctacgaatgtccgggagcgatggctctaatgacagctcataaagaattagaggatttggtttttgttcgcgagttggcccatttcaaaccaatcatcgagcagcaactggcccaagtaatttatgatggcctctggttcaatcccttaaccgatgccttgatcgcttttctaaaaaacacacaagtctatgtcaatgggatcgtacgtttgaaattgttcaaaggcaatgtcatctgtgaaggacgtaagtcagagaacagtctttacgatgaaaacttggcgacttatacgtctgccgataccttcgatcaacacgcggcgatcggattcatcaaattatggggactgcctagcaaggtccacgcagagattcaggcacaacagcaattaacagaaacactgatttagtcaataaggtgactttttccttttgagggtgaagtcaagtttctttcgaggtgagcaaaatggcaaaattatggggcggtcgtttcgacggcaaaaatgaagcatggatcgatgcctttggagcgtcgattcctttcgatcaattattggcaaaacaggacatccaaggcagtttggctcacgtcaaaatgctgatccacacggggatcattgatgaagcagatggcaacaaaatcattcaaggcttgttagcgatccaagaaaaattagcggatggtgaactgaccttttcgattgagaacgaagatattcatttgaatatcgagacctttttacatgaagaaattggacccgtcgctggcaaattgcatacggcccggagtcggaatgatcaagttgcgacggatatgcacttgtacttgaaggatgtggtaaaggaagtcatcgacttgattgcggcgttccgtcacgtactagtggagcaagctgaaagcaatatctacacgatcatgcccggctatactcacctgcagcatgcacagccgatttcttttgcccatcacttgttagcctattacagcatgttgacccgcgatcaagaacggtttacagaaagtctcactcggatcgatatcatgcctttaggcagtgctgcattggctggcaccacattccctatcgaccgtgcctatagtgcggaagcattaggttttggctcgatttacagcaatagtctggatgccgttagtgaccgtgattttattctggaatttttgagtaatgccgcgattttgatgatgcatctttctcgtttttgtgaagagttgattctttggtgcagtcatgagtttcaattcgtggaattgacggatactttctctacaggtagttcaatcatgccgcaaaaaaagaatcctgacatggcggaattgatccgcggcaaaacaggacgtgtctatggcaacctttttagtttattgacggtcatgaaaggtctgcctttggcttataacaaagatttccaagaagacaaagaaggcatgttcgataccaccgaaaccattgtgaaaagcttgcagatcatgaccggaatgatccaaacgatgcaagtcaaccatgagcgaatgaaacgttcgacagaaaaagacttttccaatgccactgaactggcggattatttagcagataaaggaattcctttccgacaagcccatgaaatcgttggtaaattggtgagtgagtgcctcagtaaaggcatttatctacaggatatcccactagaagagtatcaagcagtccagccagtgatcgaagctgacatttacgataaactggactcttatacggcagtcaagaaccggcattcttacggcggtaccggatttgaccaagtcaaacaacagatcgaagccgccaagcaatccttggcattggcataaaaaaaaggctgcagaagaactagctaaccaaaataatctcaacgatgataaatgaatggtgtgatccattacctatttgcgaatcggttctgctaactgcagagacaatctcatcgtttgattattctgtttgctgaagggcttctgtcaaagccttttttatgtctatcagaaatacgaaagcctgtgctttataaattctgatagtgaaaaacttgttatcgttttcctatacaagtacctgttggattaagaacaactaaccttttgattgttacctatcttaatcaaaaatcatctaatcaaaattcgtatcctttagcaattttcctgctgtattagcgactcgccaatcgctccccctggatgccattgcacatacatttctggggttaactttcgagcttcttgcaagagtagcgatagcttttgtaaaacaatgatttgtaccaaaaccgataagcgaggcggcttgttcaatagatccccttctttatgaactgccgcgcatagggaaacatccgataaatgactgagcgtagagtcacttcttttggagacgccgataatttttgcaccattattcttaagtgtctcaactgtatagagtagttctttggtttccccactgttagaaatagcgatcactacatcaccagcttttacttgaccacttgatccatggaccgcttccgttccatctaaaaaatagcttggcgtaccggtggatgaaagcaatgaagcaatatatcccgcaacataagagggttttccgatccccgttacatggacgcgccctccgtcagcttctgtttggagaatcgtctctttcgcagcttctaaagatccttcatcgattttgtccatcgctaaagccaattcatctagtacacactgatcataactcaatcccattctttcacctgatttctatttattgaaaaccgaataatcttttgtatccataggtgtcgtttggaagaaaaacttgacgcctttttcttggatttctcgtatagctgtcatttcttcctgagtgaaatattcatcgattttcttcaagagaattcgacttgctggataaggaagttgcacttcttttgaagaaaaccccttattcacagcctctcttagcgcacaaatatttttgaaaataatcattacactgcatttttcttccgtgtcctgtgctaaaaattccaataattgatcgactgagaagatactaactttacttttattagaaaagctaagctgcaaaactttctccaggaaaggatcatctttatgagtaggatctacaatcgcgatataactagcattaatgaagttgttccaattcaatgccactgttgcatgcaacaaccgtttgtccactctgactaatttcactttcttactcatagatctcacctgcctgctcacgcttgtcattatcacttaaatagttagctagtaaataaaactggatcttaccttgaaaactcccacgaatatcgatatgaaatagttcctcaaatcgtttgattttatacactagagtatttttgtgtaaaaacaaactttctgctgtctgtgtcagattataatcattagtgtataaatgtcttgcaatactgatcagttcagcagtatcaattttgttgattcctccattaaaataatcaaacagattcgttacttcttggtgaggaactcgatttgctaggtaattaaggacgtagtcccaaaaatggtaaatcttttgtccttccattgcaaaatttctcttcagccaatatgtatgttgatagcttgactggaatagccgcaacttattttgcacactgcctacataaaaatagcagtcacttaatccccattcttgcagatcgcgaataaaactgttgagatagtctttgaccgtcagctccatcaaattttttgggatgactttaaacataattatctcattatctgccatcaatgagtaaatagtctcatcttcattgattttgtactttaagtttgtcacttcttgcacatcaaaagctgttcctttgactatacggattgctactcttggctttgttccatcaatgtgcagttcttgaacaagacgcagaacttcgtcaatgctaaaattcctcttggcaatcagtgctttgatcaattgttcttccaaacttaaactttgtctagcagcttcttgattcatttcataaataattcttgttttaagcgactctgacagcaaatttgccacaatacttaaactatcatcctgtccatttacccataaataaccatagtctttctcttcaacagcaattttatagaagtggtcgtctttaccttgttgacttaggtcgatcaaagtaccattttttcttttatcgctactggaaataacttttccataattatctataaggccaatcgtatatttggggttttcttgtacaacaaaaataaattctttaaaaatttgctccaaattcattatattcacctcaagctaaaaaatacgtatccagcataaacataacatttcttatcaacaaatttttaaagaatcctcacacttaatcaattaaattgtaatactttagcatagacaaaattttcctgtcatcggatgctgttgtttctttcactggtcgtcgagcgggacctacttcggcaatcgcagccaattcaattgctctttttaatattgaaggtactgttcctaattttaatgcaccacgtaattcttcaatgtcattttgtaatttctccgctgattcccagttattccctctgattgcctgatccaagctcacgatcgtttccgtgattaaattgcttgtaccagcaattgccccagatgcgcctagtttatagccggctaaaattttcgagtcagatccaaccaacacgttaacctttgtgccctcagttacttctaggtagtcctttaagttgttcaagtctccgctgctatccttgattcctaaaacattgggtaattttgtcaactctctcaaaacttctttcgaaatattacatccagtatttttaggaatattgtatagaatgattgggatctgtacactgttcgctaccttttgataatgctgcaaaatttcttcatcagatggggttataaaataaggcgttatgacagataaagcatcggctcccagtgactccgctttttgtgatagttcgatcgtttcttttgtagaacatgcgccagttccaatataaacaggtactcgttttgccacatgatcaatgaccgcttttgaaaaagccattttttcttctgaatttaacacatgaaactccccgttacttcctaaggggaatattccagacacacctttttcaatcagatgatccaccaagttttccattgcctcataattgatggtttcagctgtatctctatgaaaaggggtgacaattggggtaattattccttcaaacatcttttagtctccttcactcaataactgttcatttgttaaaacaacactttcttttgcaaccgtaaaacaactctcaacaaacgcatccagatcaatcgtctcggcagttgtgcctttcatatataaatcaataaacattggcaagtttacaccagtcaccactttatgctggtattttttggtcaacgccgtcagtacattggagggtgttcctccaaatagatcaactaaagcaatcgttggcccactaatggtttcaaataattcattggcttctgccaaaaagttttcaaaagatttatcgggaagcagtgataggctatagacattcaccgtctttcctacgatcatttcagccgaacgaatcaattctgcgccaaatgatccgtgagttgccacgactagattcaatttagtcattttctctctccttcatagtttagcaatttactcaaaacaatatccgttgaaatttcgcaagttctggcttcggattcaatcgttctggcacctgtatggggtgttagatagaagttttccctcgcaagcaatgggtcctcagatttcggcggctctgaactaaatacatcgaaacaagcactgcgaatgactttcccagctaaagctttagataacgcctcctcgtcaacaatgcctcctcgtgcagtattgattaaacaagcattatctttcattctgtttaattcagcagttgagattagatttttagttttttccgttaaaggtaaatgtagggagacgtaatccgattcctgcagcaatgtttccaatgctagttgctctgcatcatactgtttcagctcttcaaccggcacatcataaacgtcataaatccgaacatgcatcccaacaccctgtgcttgtcgtgctaactgtttcccaatcgcaccaaatccaatgataccaattgtttttccatataattctctgccggtaggtttctgccattctccttctttgacttcacgaaccgtttcataaatattttttgattcactgtaaattaacgccataacatgttctgcgacagcgatagaattagagccaatggttcgtccaacataaattcctttcgattccgcgtaagcaacatcgatgttgtcggttccgacaccgaatttgcaaatcacttttaactgtgggcactgatcgataaatgcctgatcaataagatcgacaccaacaataatcccatccgcatcctttgataattcaagaaatttttcaggtgaataagcttgaccagtgttgttataactcacttgaaatccgtgagaacgcagtttgtccaattccttttccccataatttgcaaaaccgcgaggtgtaatgactatcttcatttgcgttttctccaatcttccttacaaaataccaaaaaaggttagcgcgattgcaaagagcatcgtcgcaataatgatctgcaggtatttgggtccttttttcatgatataaaaatacattgccataactaaacagaaaggcagaaagctcggtagaataccgtcaataatttcttgaaccgaggttgtccctgtttcattgctaaattcaagaatcgtcgaaaaattgacatacgccgcagacagacacccaatcataaagagaccaacaatactcgcaatgtcgatgacttttttgattgatccagaattcaaaatatttaatacagaactctttcctagagtgtatcctttattaatcaaaaaccatgaccagccaaaactccatgcgatgtagataactcctgggataaatgctgctagaattgatccgttcaaagccataggtacaaaaatcgcgagtggtattgtagctacgataccttggtcgacgctatcaccaatccctgctaaaggtcccattaaaccaatttttaacgactcgatgacttcaggtgtaatctcttcatttccattagcccgctgttcttctaaagaaatgacgattccatgaataatacttccccaatcacaattcgtattaaacatttgtacatgtcgtttcatcgctgcttgtaattcttctgggtcatctttataaattttttgaagtgtcttatttaatgaatagctgaaagctaaagcctgcattcggtcaaagctaaccggaacctcgacagctaatgtccatttccaccatgcttttaacaaatccaatttcgtaacctttttttcagtagcaactgtcatttctgcactcatgcaaattccccctcatcagaattttgtttgaataatgaactaatcattgcaatacatacagcaaagactgcccctgtcaacattgagaatcctagaactgcatacataaagaaccctaaaacgaaaaatggtaaatattgttttttacccatcacgaccagagtcaatgcaaatcctaatgccggcaacattcctcctgcattggctaatccattcattaaccattccggaataacatttaagaatgcctgaatgacatttgtgccaaataaggttgcgataaataccggtgtaaagtatagaacaccgttcgttaaccaaggaatcacgaaagagaataaagacaattgatcatatttattcgcttcaaccaacgcatcagcacgcgtattataaaatgagttgatcgtacgacgaacattgttgatcaatacaccaagtacaccgaatggtactgctaaagcaactgctgcgctagcctctagaccactagctaaggctgctggaatagcgatacatgctgctaaagcttgatcgcttggaatattcccaccagcctcgatcccacccatgtacatcaactgaatcgttgctccatataatagtccagcttgaacatccccatatacgagaccaataaaaacacctaaaactaccggttttctaaaggcaaaagaaacgaagtaactcgcacgacccattgctaaccaataaattaaaccgactaaagctgattgaataaccatgttttcactccttactctttatgctaatttttttactgcattttgaagtgtttctgaagggtaatctggtgtcgtttgaaaatagacattgattcctttagactcaatcgctaataattgatcggcatctttgcgatcaagcgtaatggcattgttgactgcctttctaccagggcccccacctaagccgccaatttgaatttcgggtaatgccaaaccggcgttgatcgcattggtcaattcttgaacactttttagtaaaaccaaaatacgatttctctcaaattcgccattttcttgcgctgcgacagcttcttcgacagaaagaatccgaatccgaacccctttaggtgcagccattttaaaaacatcttgcataaactcatctttgcttagtgctgtatctactgtcacgatttcgttgatatcacattgctttagccagcgagtgatcacctgtccatgaattagtctaaaatctactcttgtcagtgcaatactcatatattttccccttttctttcctattacttagtaagcggtttctaattgttgcttgttaaatttcctttacccactcttttttccaaaactacttacggtatttttggacgacagtatgaatcgcttccgcattggtcctaatttctgccaccgttccttttgtcaataggctcccgataccacagacatcaacgccacgttgtagccatgtttctatgttctcaagattgatcccgccactagctaaaattggcatatctggaatcggtgttttaaagacagttactagtttagaaccataaaaatccgagattggaaaggctttgatgaaagcagctcccgcactcaatgaatcgacagcctctgtaaaggaagtacagcccggtgcataaggtatttggtatcggttacatatctttgcaacctcttttgaataattcggtgcaataataaactgtgcaccatgcagtattgcatgtctggctgtttcgctatcaaaaactgtccctgcacccacacataattgatccccatatttttctgtcaatttttttatgatgtcgccagcactattcaatgtataactcatttccatcactggtacaccaccggcgatacacccatcagcaatttcacacgctcgttcaaaggattccgtgcggacaattgctaatgcaccggtttgatagattctctgtgtaacactcatttttttcatcatttctcctcacctcacctataatttaaatcgaatgggaaaatattcatatgtttgaacaaacgaaaaaaatctccttttttggatgacagacacaatccacttgatacgaaagcgttttctatcgcttttaaaaaggtattttttagcaaaacaaccctgtagtagtggactttggaataaaaaattggaaatcgaaagaagccctgatcattaataaaggacagatttagcgtaaaatcgttcatttaaccgaactatctgaaggacaggttctttagcaaaagaaaaaaaccggaacagaagtcacacttctgttccggtttccactctatttatacagtttgatcagaaatcttttttatgctcactgaatcaatgacgcacacgtgattttgctggatcgatttgaggcgcttcacctaggtgcgcttggatcatccagatacgtttttcagtatctgttttgaagccgataaagatatcttgtgttggatcatcgccttcttcaccactgacttcaatccctttttggtataagtcagctagataacgataaccttcaacaagtgtagctaaacgttctgggatcgtacggtcccagttgccgatttcatcagggatttgtgtattgtctgccatttcccgtaatgttgagtatggtgagccatctaatgtgatcaagcgttcagagatcacatctaattgatcattcaagtcatccataaaatcatccatcattggatgtaaagttaaaaagccaggtcctcgcatgtaccagtgtgtttggtgaacgaccattgccatttgacttaagtcagcaacgagttgattcaacacttcttttgtttgttcaaatttcattacgattcctcctttaaattctctatttcaagcatagtatgaatctaaaaaaaagtacaccaaaacctactacttgagaaaatttctcagcttttcacgtatttctttatgaggcaaaggaggaggagacagtgtatctgatgtggggatatattttaggtgcagcggtatatgcgtttattcaaaccatttactggcaggatgatccaagcgaatattttgatgattttcatagaaaacctcctattttctattccgtggcccaacagccattttttccttttatcaagcatgctcaagttttattggattgcactgctgctagtttattggcaaaaagcgtttatgcttggctgatctggcttgctttcctacaaccatccgtaggggagtgttggctggcgttggtctggttgaacagtgcttacctcctcactttgacagatctctacgattatagtgtcaagggagagattctctatccttctttgtttttattggcttttaccaatctcatgaacgcacagccttttcattggcagaacttcctgctgcttctgccattattctttttcgtttggcaagaacagctgggagatggtgacttattcttgattggtggttgggcgccttggctgtctacttaccaactcctgtggctgttgattatcgctagctgctgcggactcttgtttttttcattgcatatgctgtttgtcagaaaccaattacgaatgctgccctttgttccttgtttgagtttagcattagtcatcgtgcgtttcctttaacaaaaaagcccgctgtttcattagcgaaacagcgggcttttgtttagttttggttgttcaatgcatcttctgcagccatttgcgcttcaatgtcggaaatactatagacattttcactcgcaacagtgacttcttttggttccatttcacggtagcgagccataccagtacctgcaggaataatcttaccgatgataacattttccttcaatcctagtaatggatctttcttcccgcggatcgcagcatctgtcaacacgcgcgttgtttcttggaaggatgcagcagataagaagctgtttgtttccaaggatgcttttgtgataccaagtaagactgggcggctggtagcaggaaccccgccggcaactaatgtgttgtagttgcggtctttaaagtcagcgatatccatcaatgttcctggcaagatgtctgaatcacctggatccatgacacgaactttacgcaacatttgacgaaccattacttcgatatgtttgtcgccgatttctaccccttgcatacggtaaacgcgttgtacttcacgcaatagatagttttcaacagacaagacgtcacgtacttgcagcaattgttttggatcgattgatccttctgtcaatggtgcaccacgatggataaagtctccttcgaccactttcatacgtgcggtaaatggtacagtataggtccgagtatcagtttcccctttgatcgtcacttctttcgtacgagtagacgcatcttcagagatatcgattacttcaccggtaacttcagtgatgaccgcttgacctttcggattacgggcttcaaagatttcttggacacgaggcagaccttgagtgatatcatcaccggctaccccaccggtatggaatgtacgcatggtcaactgagtacctggttcaccgattgattgggcagcgatcgtaccaactgcttcaccaacttcaacttctgaaccagttgccaagttacgaccataacaatgtttacatacaccatgttttgtattacatgtaaagacggaacggatcgaaacagtttcgattcctgcgtcaacgatttctttggcaaggtcttcagtgatcaattgatctggtccgacaatgactgcaccagtctctggatggatcgctgatttacgtgtgtaacgtccaatcaagcgttcttccaatgattcgatgatttcgttaccttcacgaatggcttgaatatctaagccacggtcggttccgcaatcttcttcacgaatgatgacatcttgcgccacgtcaaccaaacgacgagtcaagtaaccagaatcggctgtcttcaaggcggtatcggtcattcctttacgagccccgtgagtagagataaacatttctaagacagaaagtccttcacggaagtttgaaatgatcggtaattccatgatttgtccattcggcgcagccatcaatccacgcatcccagcaagctgagtaaagttggagatgttaccacgggctccagaatcagacatcatgaagattgggtttttcgcttccaatgattccatcagtttcaattggatctcatctttcgcggcattccagacaccgattacgcgttcataacgttcatcatcagtgatcaaaccacgacggaattgtttcgtgatcgtttcaacttgtttgtgggcattttcgatgatgtcatgtttttcatgcaagttcatgatatctgcaatacctacagtgataccggccattgtagaatggctataccctaagtctttcatgcggtcaagcatccgtgatgtttcagtgatgcggaaacgtttgaagacttcagaaataatatttcctaagtttttcttcttgaatggtccgactagttcttgttctttgatgaaagcaggaatatctgttccagcttcgacaaagtacttatctggtgtttggactgtcaagttgaaatctgttggttcattcaagtaagggaattctgttggcatgatcgagttgaagatcactttcccaacagtcgttaccatcaagcgttctttttgttctgcagtaaatggtttgtcccctaatgtgtttggattgatcgcaatacgggtgtgtaaatgcacgtaaccattgcgccaagctgttactgcttcgtccatgtcgcggaagatcatgccttccccttcgcggccttcttcttccatcgtcaagtagtagttccctaggaccatatcttgagatggtgttacaactggcttaccgtctttcggattcaagatgttttgtgctgctaacatcaacatccgtgcttcggcttgcgcttcttcattcaatggcacgtggacagccatttggtctccatcgaaatcggcgttgtaggcttcacagactagtgggtgcaaacgaatcgcacggccttcaaccaatacaggttcaaatgcttgaattccaagtctgtgcaacgtaggtgcccggttcaaaagaacagggtgttctttgatgacgtcttctaggacatcccaaacttcatcttcttggcgttcgattttacgtttcgcatttttgatgtttgacgcgatttcacgagaaaccaattcacgcatcacaaatggtttgaacaattcgatcgccatttcttttggcaatccacattgatacatttttaggaatggaccaacgacgataacggaacgaccagaatagtcaacacgtttacctagcaagttttgacggaaacgaccttgtttccctttcaacatatgagaaagagatttcaatggacggttacctggtcctgcaactggacgaccgcgacgaccattatcgatcaaggcatccactgcttcttggagcatccgtttttcattttgaacaataatattcggtgcatttaagtctaatagacgtttcaagcggttgttccggttgattacacggcgataaagatcgttcaagtcacttgttgcgaaacggccaccttctaattggaccattgggcgcaaatcaggcgggataactggaataacatccatgaccatccagcttggtttgtttcctgaagcacggaaagcttctaagatatccaaacgacggatcgcacgtgtccgtttttgtccggtcgcatttttcaattcttcttttagttcggccacttcgccgtctagatccacaccatccaacaattgtttgatggcttcagcacccatcgctgctgaaaattcttgaccgtattggtcacgtttttcacggtattcccgttcagtcaataattgtttcttctcaagactagtgtttcctggctcgatcacgacataagaagcaaaataaatgatttcttccaaggcacgtgggctcatgtctaacactagacccatccgtgaaggaatgcctttgaagtaccaaatatgtgatacaggtgccgctaattcaatgtgacccatccgttcacgacgaacttttgagcgagtgacttcaacaccgcaacggtcacaaacgattcctttataacgaattcgtttgtattttccgcaggcacattcccagtctttggttgggccgaaaatacgctcgtcaaacaacccttcgcgttcaggtttcaacgtacgatagttaatggtttcaggtttttttacttcaccgtaagaccagcttctgattttttcaggagaagccaaaccgatttgcatactttcgaatttatttacatcgatcaaaaaaggttccctccatttcatttcatggacatatccgatagaacacgaggttgagacctccgtctgattttgacgggtgtcccctcgtttctattattgcaagcgatcttctgctgtctcgatttgttggttcaaatcatcggcggcatttttagcttctgtttgtgcttgttgctcaatttcacgagcattttgttgttcggcaaattttgttaaggcgtccacggtgatcaagtcatcatcgtcatcatccatatcacgcaattcaatctctgcatcatcaatgtctaagacacgcatgtctaaaccaagtgattgcaattctttgactaatacgcggaatgattctggtacgcctggttttggaattggttcccctttaacgatcgcttcgtatgtcttcacacgaccaacaacgtcatctgacttgtacgtcaagatctcttgcaaggtataagcagcaccgtatgcttccagtgcccaaacttccatttccccgaaacgttgtccaccaaattgtgctttaccacccaatggttgttgcgtaaccaatgagtatggtccaattgagcgggcatgtaatttatcatcgaccatgtgagccaatttgatcatatacatgacacctacggagattcgaccatcaaatggttctccagtacggccatcatacaaaacggttttggcgtcgctagccatgccggcttctgcaactgttgcccagacatcttcatcgctggcaccatcaaagactggtgtagcaacgtggattcctaattggcgggcagccattcctaagtgtaattccaatacttgtccaatgttcatccgtgaaggcacccctaatgggttcaacatgatatcaactggtgtaccgtctggtaagaaaggcatgtcttcttctggcataatgcgagaaacgacccctttgtttccgtgacggccggccattttatccccttcatggattttccgtttttgaacgatatacacgcgaacgagcatattgacacctggtgacaattcatcgccagcttcgcgggtaaagattttcacatcatggacgattccaccaccaccgtgaggtacgcgcagagaagtatcgcggacttcgcgggctttttcaccaaagattgcatgaagcaagcgttcttctgcagatagttccgttacccctttaggcgttactttaccaaccaacagatcgccatctttgacttccgcaccaatgcggatgatacccatttcgtctagatctttcaatgcgtcttccccgacattcgggatttcacgagtgatttcttcaggtcctaattttgtatcacgagcttctgattcatattcttcaatatgcacagaagtgtagacatcatctttcaccaaacggcggctcatgatgatggcatcttcatagttgtacccttcccaagtcatgaatgcgactagaacgttttgtcctaatgccatttcaccattttccatggatgggccatctgcaaggatgtcgcctttttctactttttcgccaagggctacaagtgggcgttggttgtaacttgttcctgagttagaacgacggaatttcgttaccgaataaacatctaatgcgccattgtcgcgacgaacgcgaatttcagcagcatccacatattcgacgattccatcttgtttacacaataatgcagcacctgagtcatgggctgatttgtattccataccagtaccaacccatggtgatttagggttgatcaatggaactgcttgccgctgcatgttggcacccatcaaggcacggttggagtcatcgttttccaagaatgggatacaagctgttgcgactgcgactacttgtttaggtgaaacgtccatgtagtccactttgtcgatcgacacttctaagttttcagaagtcgcacgagccataacaacatcattcacgaatgtaccgtcttcattcagcaaactgtttgcttgggcaacgacgtaatggtcttcgatatctgcagtcagatagtcgatttgatctgtcacacggccagtctcccgatcaacacgacgataaggggtttcgataaagccatatttattgactttggcataagacgccaagctattgatcaacccgatgttcggtccttcaggcgtttcgatcggacacatccggccatagtgggaatagtgaacgtcccgtacttcatatccagcacggtcacgcgtcaaaccaccaggtcctaaggctgataaacgacgtttatgggtcaactcacccaatgggttggtctggtccatgaactgtgacaactgagaagaaccaaagaattctttgatacttgctacaacaggacgaatattgatcaattgttgcggtgtcaatgtttctgtgtcttggattgacatccgttcacgaacgacacgttccatccgagcaagtccgattcggaattgattttgcaataattccccaactgaacgaatgcggcggtttcctaagtggtcgatatcatcaacattgccgataccttccattaaattgaagaagtagctcatagaagcaatgatatccgctggacgtactgtacgaacggtcgtatctggatagccattaccgataacattcacttcttgttctggatcttttggtgaaaagactttgatgacttgaacagtcattggttctgtaacaacaccgtcttctgatgggtagtaagtaacactatttaaaccattatcgataaaggcacctaatgtttccatcacttggtgagtcaacacagttcctttttcgacgatgatttcgccagtttcaggatcaaccaatgtttctgctaatgtcaaattcaatagacgtgttttcaagtctaattttttgtttactttgtaacgaccaacatttgctaagtcatagcgttttggatcgaagaagcgagcattcaacaagctgcgtgagctgtcagccgttttgggttcgcctggacgcagacgttcgtaaacatctttcagtccttcttctgtccgagagtcgcttgcatttttgtgcaagtctttttcgattgtgttgcgtaacgaatcactgtctccaaaaatttcaaagatcgtgtcatctgaaccaaaccctaaggcacgcactaacacagtcaaaggaatcttccgagtacggtcaatacgtacataagagatgtctttcgcatctgtctccatttctaaccacgcaccgcggttagggatcacagttgagccgaatccttcttttccgttcttatcgactttcccatggaaataaacacctggtgaacggactaactgagaaacgatgacccgctctgccccattgatgataaacgtaccttgttccgtcattaatggaaaatcgccaaagaagacttcttgtgacttgatttcgccagtttcacggtttgttaaacgcaatgtgacatgcaaaggtgccgaatagttggcatcatgtgcacgagcttcttccactgtatacttaggttctttcaattcatagtctacaaattctagggacaaattgccgttaaatccttcgattggcaaaatatcttcaaacatttctcttaggccctcatctaagaaccattggtaagagtcggtttgaatttcaatcaaattcggtaattctaatacttcactgatccgtgcgaaacttctacgttcgcggtgctttccgtattttactacgtgtccagccaagctcttcacctcttcataaagtctttcaaaaaggctatccgattatttacaaaactgtaacaaatattaaatatatattacagaaagcattttttgcggcttttaggcaaaaaaaaaccaaaaatagaacagatgcaatgggcattttctacttttgtttccttattcccaagccgaaacggacaatatttcgtttctgcttttttctttcagatagtttttgcaactccctattatacagatgaagcacattgatgtcaagctttcattgaaagttgcaacgcttttccgatgcatgcaaattctaagttttctttaagaaaggattctctaaaattagaaaaaatgacgagaaatttctttgcattttcttgttttcttgctatgctagcaaaaaaagcatgagcgttacacgtgaaacattttgaaaggagcaactatgacaactagagaaaagattttggcattgttgcaacaagaaacctccgttttatccggagaaaaaattgcccaaaaattggacatatcacggactgccgtctggaaagcgattaaagaattagagaaaaaaggctaccgctttgaacattcagccagcggctatcgctatttatcagcagatcgttacgaacaacgcacgttacaggaagcactgccgatggtagcaacgatccagatcgctgaccaagttgagaccacgatgaaagaagcaaagctagctgctttatctgaactttcgactccggctctatttttagcagaaacacaggtaggcgggcatggtcgattcaatcgtcctttcttttcacccaaaggaaaaggaatctatatgagcttattgctgaagccaaatcataccttcagcgagttgcctcaatacacattattggcagcggtagctgtggcacaagcaatcgatgagttgaccggcaaagaaacacaaatcaagtgggtcaacgatatttacttagaaggaaaaaaagtctgcggtattttatctgaagccactagtgactttgaaagtggccgcatcgcttcgatcgtcatcggcataggcatcaactttgcgatccctcagacagctttcccagaagatatccagcaaagggcaacctctctctttccaactggggaagctcctgtcaatcgtgcgcgcttgatcgcagcagtatggacacgcttctttgacttgttggatcaattaccggctgatgattatctaactatttatcgtcagaaatcatttgttcttggtaaaaccgtttgcttcacacaacaaggcatccgctatgaaggagtcgcagagtccatcactgctactggtgaattagtggttcggacaacagatgatgtcaaagtcctttcttctggtgaaatcagtctggagaaatattcttagcagcatttttttcaaaaaaccaaacaaagacccgtcagatcaagaaagactgctcttacgatgcagccattctttgtctgacgggtttttgtcttgctatttagtgaacgagcatttgccagatcaggcataaaattaggcctagagcatagctactgttaaataaaatcatgtttttgattgaataaccaaagcttcttgggtgaggcaaacttgcttgatgctctttcaagttttggcgaatcttcggtaaggttagaaagacgagtaagatcggccactgataaagaccaaacaaaaatccgatcaaaatcgcaccgtaggatgccagcatcaatccttggaaaagatgaatgccgttggtccgaccaatgtaataaaccaatgtgtaccggtggttctcaatatctgtttctaaatcacgcaagttatttgccaacataatattggcaatcgtaaatacaaggggcaaggatgctaatacaatggcacataccgcccacagatgacccactaatccgaaggttccggtcgcaaaatcaatgtctaaataaaaaactttttgtgtgacagtgttcagatagatggtgatggcaaaaatacctaatcccatcgtcattccactaaagacttcccccaatggcatccgagataagggaaccggcccaaaggtataaaacaccccgataaagcatacgactaatcccatcagcaataaaagccagcctgtcatccaagtcagataaagaccgatcaacaacgttagcgccaacatgccaaaaatcatgttccgtacaagggtttcgggaatcttttcccgaccgatcacattttgttcatacttataaaccttagactttgcttttttgaaatccatgtagttattgatcgatgttgtcgttaaatcaaacaagatcatccctacaaaaaatataacggtgttcaatggatggaattcatggaagtatacgagagaaaacaagattcccataataaacggaaaaatacttgcaaccttagtccgaatctcaacaacttctaaaaatactgcaagagacacaagatccctcctcttattttaaatcggcacgatcgcccatcgtgtaacctgattcttcagacagcttaaaggtatctttgattccatccgtaacatagacgatcccttctttcgtgatgaagatcgcatctgttcctttgtcggtgtgctgctcgatatattctaaaccagctttgatccctttatcaaaaaccaccgtcgtcaaaccatcgccatcgatcgatttatctgtgatcacagatacactggcaatgtcattgtcatacggataccctgtttctgaatcaaagatatggtgataggttttgccgtcgactttcaaatagcgttcatagattcctgaagtgaccaccgttttgttggtttctttgatactgccaataatggaaccgcgggcttcgttgggatcttggatccccacattccaaggttcgtcttcaccacgattgctatgtcctaacacatagacattgccgcctaagtcaacgattgccgaggtaaccccttgttccttcaatactttgactacttcatccgtgatatatcctttagcgatcgctcctaagtcaatgatcatatctttgtcttttaaatagacggtcttctcatcatcattgaactcaactttccgataatcgatatgttttagtgcttcatcaatttccgattgttccggtttgcgagcatcatcaaatccaatccgccacaattgggtgatcgcaccgatagccatattgaacccgccattagattttttgctatagtcataggcatccttcaatagaaaataaatatcatcagaaactttgactggtttgattccagcttgggcattgatctcgtcaacttctgatcctgcttggttgatcgtaatcttgtctcccaattctttgatgcgggcaaacgctggtttcatcgcagattctttgccttcatcgtaaattctgatgcgtgtatacgtgcctaataaaaattcttcttgaaaatatggttcgtctcttaattgaacagtttctttttcactgccgcaagcggataatattgtgataaaaaaaacaatcaatgcaaaaaacggtaatttctttttcatggtcttcctcttttctgttgtattcaattttattataatagctttttttttctaaaatgaaaagggttggcgccagaatcttagtttcttttgcgattctttaatctcttctgtttctttatcagacagagggagtccacgtaggaaggttttctactagaatttttttattattggtaggttatttagcgcttttgaacataaaaaaagcggtactctacatcagaataccgcttgttcatttatgaattattcagtgacgatgttgtccacttggataggtgtttcgtcccctttttctgctgcgttcaacaattgttgtgcatagatcacgaagctgtggaagctgtgtgtcgcaccagaaacaacatccatatcagcaactgaaccatcttcagcatttactgctgtcacgaatgcttcgttgaagtttggaataaattcttctgggtttgtaccagattttgctttcatgttttcgttgtattccgcatcatcttttttagatttgccatcttcgttaacatagtcatagttagattcagacactttgccgtctttgacagtgattgagaatgctacacggtagccatttgaatagttcttttcttctaagctatacgtaccatctttcaagtctgcaccgttgtcgatctcgattgtatctgtgttgcctgcttgagcagcttggatcaattgttgtgcatagttttggaatgaatcgaatgagtgtgtcgcaccagaaacaacttcaattgctgaagggctttgtgccgcaaccaattcttcattgaatttaggaataaattcttctggactgattcctgctttggctttcatgttttcgttgtattccgcattttttgtttttgattcgccgtctgcattgatgttgtcatatttagattcagtgattttgccatctttaacagtgatttcaaaaactacgcggtaatcatttgaataatttttttcttctaatttatatgtgccatcttgcaatggtgctcctgcgactactttcgcttctgattcagaagttgctgttgctgattcgctgctagcgacttgtgaagtactttcttttgttgacgaagaagctgacgtgttgttgtcagatccacaacctgctaatactaacgctgagaatgaaaataccgccatacctaccattaatttctttgctttcataatgctccaccttttactaattattttcccacaaaaaaagtttgtgattcatctaacattttaaagtaaattagaaatatgtcaaccgcttccctatagcttttgtgaatatttttgaactttttttgattttcgcaaattttcacgaatttcatgaaatatcgtattttcctatcagaaaagttagacaaacgatggatttctatatataataggaacgattgtgtatttattatcatagattattttttttaaggagagatttgcaatggcaaagaaaagcattgtcgttgtcggtgcaggctatgccggtgtttcagcaaccaagtacatggcaaaaaaattgaaaaaagacaatgatgtagaaataacattgatcgatcgtcactcttatcacaccatgatgaccgaactgcacgaggttgccgggggacgtgtcgagccgaccgcaatccaatatgacttgcaacgtttgttttcacgtaagaaaaatgttcgcttagtaaccgacacggtaactgctatcgataaagaaaagaaagtcgtacaaacaaaacaaggcagctattcctttgattacttgatcttaggtatgggtggcgaaccaaatgacttcggcactccaggagtaaaagaacacggatttactctatggtcatttgaagattctgttcgcattcgtgaacacatcgaaaaaactgttgctaaagcagcaatcgagcctgatgcagcacttcgtaaagcaatgttgactttcgttgtctgcggttctggctttaccggtattgaaatgatcggtgaactgatcgactggaaagagcgtttggctgaagactacaaattggatccaagcgaaatcactttgaaagtggtcgaagcaatgcctacgatccttaacatgttggatcgtaacgatgctgccaaagcagaacgctacttgaaacaaaaaaatgtcgaattagttctgaacgcaccaatcgttgaagtggctgaagatcacatcaaattaaaagatggttcaacgatcccaacttatacactgatttggacagctggtgtgaaaggaacgagcgacgctgcagactttggtctagaaactgctcgcggtttccgccttgttgctaacgaatatatggaagcaaaaggttatgaagacaaaaatatctatatcattggtgacttggtcttctatgaagaatttccaaatacaccaacaccacaaatcgttcaagccgctgaacaaactggtcatacagctgcatcaaatatcgtcgcagcgatcaaaggtggcgaaaaacacaaatttaaaggaaattaccaaggattcatggtatcgattggcgctaaatggggcgtagccaacttattcaataagattcaccttagcggtttcttagcaatcattatgaaacatatcgtcaacttgaaatacttctttgacattcgttctggctactacatgttccaatacttgatgcatgaaattttccatatcaaagatgatcggacagtggcgcgtggtcatacttcacgttacggaaacgttctttggagtgttccactgcgaatcttctacggtctggtatggttcgttgaagctttcaagaaaattctaggtacaaatggtgaagtctttaagccaggaacttggtttggcgaaggttcttggttccaaggaaacagcgtattcccttggacttgggaatatcaaactgttgctgatgcagcaagcggcgcgagtgaagcagctgacgctgccagtgcggcaagcggtgcaggcgatgctgccggcgcagtagcaacccaagcagctcactttggtttaagttatgcctacggcgaacaaccaatggtcgtgatcgaaaaatcaccagattggtttacaaaagtgatgcaatttattatgcctaacaacgatgtagcaatgttcttccaaaaattcatggtcttctttgaaattgctttagctttagcattgatggctggtttgtttacttggttagtgaatgcaacgacaatcgttttagtcttgacattctgtatgtcaggtatgttctattgggttaacatttggttcatcccagtagcctttgcattaatgaacggttctggccgtgccgttggtttggatcgttgggtgatcccatggttacaacgtacacttggtaaatggtggtacggtacaccgcgttccttatacggtaaaaaataatcgctttataaacgagactgaggcagcctgatcctttgatcaatgtctcagtctctttccaagttaagcactttttttatctactagaaaaaccttctcttaaaagtagtagaaaaccagcggattatgctagaatgagacacagaacttcaaaggagtctttctgatgaaagtaaaagaatttatccgtcgtgcccacctgaagccttgggacggggtcatcattctggtactgatacttagctcgtttttaccaattttgatttttgggcaatcacaaagtacccctactgccgccaaacaagctgttttgcgagttgatggcaaggagatcaaagagtttgatttgatcgaaggacaagatagctacacgtatcgatacgaagatccagatggtgattacaatctcattgaaatcgctggtgaccgcatccgcatcaaagaagctgactgtggcgatcaaatttgcgtccgccgcggctgggcctcaaaaaatggcgaaacaatcgtatgtttgccacataaattagtgatcgaagttcgtgcaacagatgggagtgagacagacgatctaatctactgatcgtgatactatgagtcgtttacagaaaatcattttcatctcattattagttgctcaaggagtcgttatcggtttgattgaaaatatgattccgtatccttttgcctttgctcccggagctaaattaggtttggccaatctgatcacgatcattgctttgttcactatgcctaaacgagacagttttttgctgatatggctacgtttaatcttaactacactcttaggcggaactgtttcaacattcttatatagtatgagtggttcacttttgagctatttcggtatgttgctagtaaaacaactaggacctaagcgcgtcagcattatcgggatcagtgcagctggtggttttttacacaatgttggccaattggtcacagcttcttggattgctcaatcctggagtgtcatgctttacctacccgttctcgcatttttcggtattctatcagggatcgccatcggcatcgccgccaactatcttttgcaaagagtagacacattacggcgatttcagcttgattatgaacggcaaaccaatgtcaagtggcgttctgattcaaaataaaggagtcatttatgaaacttcatccaatgtggcaagcatatcctgcgttgcaaaacgatttatctgaatcgctgcaattaatggaacaatccttgaaactaaaaaataaagcagtagaacaagcgatattagcgatgatccattctggcggcaagatgctccgcccggcctatcagttgttgttctctgaattcggagaagagaaagattctcaaaaagcagtagcactatccgcagcgatcgaaatgctccatactgcttcactgattcatgatgatattgttgatcaagccgatactcggcgaagcttgcctactatccgtgcacaattcggtaatgatgtcgccgtttacgcgggtgattatctctttgtatgctgttttaaactaatggcggattacgctggttctctcaaaagtctgcaaatcaattctcgcagcatggaaacaattttagctggagaattaggacaaatgagcaaacgctacgacctgaatgtgacgattgaggactatctggaaaacatttccggtaaaacagctgaactgtttgctctaagctgctttatcggggcttatgaaagtggggcttctctacgtttagccgatcaggcaaaaacgattggtcaatccatcgggttagcatttcaaatcatggacgatatccttgattacagccaaagcgaaagtgccttgggtaagcctgtccttgaagatgtcaagcagggggtctactcactgccgttgttgttggcactgaaaaaagagcgggcagtgctaacaccattactggagaaaaaagccgagatgaccgatcaggaagcgcagcaagtctaccaaatcgttcacgacagccatagcgttgaagaagcacatcaattagctgctcgttatacaaaaaaagccctgcaaggaatcaagaaattacctgatcctggaaaaaataccaaagactatttgtatcagatcacaaaccaaatcctagctcgcacaaattgagtggtttttctataaataatagtttgataagtgatttagaggtagctgctttcaactagctgtctttcagacaaaaaagaacgatctccgattgattagacgacacgtcttctataatcggagatcgttctttttctttacttcactttctcttgactgtttatcgcattgtaacgaactcttctgctccagtcggatggattgcaacggtattgtcgaaatctgccttagttgctcccattttgatggcgacggcgaatccttgcagcatttcgtcaacaccaattccaataccgtgtagaccaatgatcttctcttcttttcctaaacaaacaagtttcatttcacatttttgacgatagtcattcaatgcaaagtacattggtgtaaagcgtgaacgatatactttgatttcttcttcgccatattttgcgattgcagcttcttctgaaagaccgatcgttgcaattggtgggtgcgtaaaaatgactgtcggcaccaaatcataatctaaatgtgcctcagtttgaccattgaacaatcgttcagacaagcgacgacccgctgcaatcgctactggcgtcaactctaatttgccgatcacatctccaactgcaaagatcgattcagcagtcgtattttggtacttatcaacaatgacaaagcctttttcatctagagagacatctgtattttccaaaccaaggtgttgggtattgggcactcgtcccccagcaaacaacacacagtcccccgtcagtgtttgaccattttcaaagaaaaccgtatattgtccatcacgttcttcgatcctttcagctacatagccggaataaaggtccattcctgcttctcgataaatttctactaaattgtcagttaacatatgatcaaacgcccgtaatggacgttctttacgataagcccaagaaacgtgactgccaaattgctgactcattccgctaagttctgccgcaatgtatcctgctcctaagacgatcatttctttaggcacttcttttaaggcaaaaaagccattggaatcaatcgcatgttcaccaccaggaatcgacatgacactaggttttcctcctgtagcaattaagatctttggcgctctgtattcttgtccatcgaccgtcacagtatggttatccacaaactgtgcataaccgtggataacttctactctgttgctatctaagcctttttgatatgctgtgtgtaaaaaatcaatatatttttcacggttatccacaagttgcttgaaatcaaatttatccacatgtggataaataccatagctcgtggcatcacgcttaatcatttctaacatttcacttgcttgccacatcacttttttgggtacacagcccacattgacacaagtaccccccagctcattgccttcaatcaataaaactttagctccatgcattcctgcacggttagcagaagcaatcccgccactgccaccgccaatcactatgtaatcatactcttgcattattggtctcctccttaggaacaacttcattttggtgtatatcgaaggatttttcaaatcttacaaaaaaatgcgacagaaagcaccgagtcaatgataaagggagaggaacataacatgtacgaaattcaaactcgcttttagcacagtgcgctacccctcgaatctcattatttttcctttatcagccttggatacttctgtcacagtttttattttttcttccggatcatgtcgccaacctgaacaggttcagcgacgggcatcgttagaagcatcatcggatttggcgcgcgatcgatcgattcaccgtcttcattatacatgacttccaccttttgatggaaatgatggaatccaggtccataaaactcgatctcgtcccccaccgaaaacaaattccgctgccggatcgtggccatctttgttgcgtcatcataggccatgacttccccgataaacttgtattgcgggattttacgccgaggaccaaataattgctcattttcactcggtgtatggtaataaaatccggtagctagttctctttgcgctaccttccataattcatcaatccactcttgtttgcagacatagttctctggatcttccatataactgtcaactgccgctttgtacacattcgcaacagttgaaacatagtggatcgatttcatccgtccttcgatcttaaaactatcgacgccgttttcaatcaagtcaggaatatgttcgatcatggacatgtcgactgcactcattgagaattcttcttcgatcgttccattctttgtcaaactctttctttcttgtgcaaaaggcatatcaaaaagatcatatttccaacgacaagattgtgagcaaccaccacgattggcatctcgcatcgacatgtgattggacaatgtacaacgtccagaataagagatacacatcgccccatgaataaaagcttcaatctccacactcgtatttttgcggatttcggcgacttcttccatggatacttctcgagccaagacaactcgctcaagcccttcttctcgccaaaattctagtgtttcataatttgtcgcggaagcttgcgttgaaagatggatcggcaatcctggtgcttctgtcgcacagatctcgatcaaagcaggatcagacacgatcaccgccgaaattcccacatcccgcaattgacggaaaaattccccagctccttcttgattgccttcatgggtgaccatatttgctgctacatatactttagcattatgagctttagcaaatgcaaccccttcagccatctcttcataggtaaagtttccggcacgactgcgtaagccataggcgttgccgcctatataaacagcatccgccccgtaatgaatggctgtttttaatttttctaatgtaccggctggtgccaatacttctggccgtttcaatttttgtttgactgtcatttccattgctccttacttgatatcctctggattgatcgcataaaaaccggtatctaacccccgttgagctggatgtagctgacgtacttgttcactcaagctagctgcttgttcagcagtccatgtgccttcagtaagcaactgcttcgcctgtgcaaaacaagctacgatcgagacaaacgctgtccctggagtaaataaaccgtctaacttccaagtctgataccccgtttcaaaaagagactgcaattcattcatcaaattgatgtcattattggcgaaaatatgcgtgccatgactgtcttcataaatcgagtagtgggtatcctccttcttgggttctgataaaaataaacctcgctcacgagatttttcatcttcctgttgcgtataattataataattttgaagcaatggacgtttcgactgatggatgcacgttgccccatagacaagcacttccgcaggaatcgttagctgtggtgctaaaactgtcatttctccaaaggggacttctcttgctaaaactgctccaatcgcccctttttgcccccaaaaattgatttgtctagcactggtgaccagcgtctctccatcgtatacaaacggcaatgccaattccggattctttttcatacgataaatgattcctggatcgccgatagaaattttatcaacatggttggccttcaaaaaagccaagtattctggaactagcgtcattttttgcgggtgcatgatgccattgactgccgccatcgcttgttttccttctgcttgcgctaagcggatcaattcgctttgttcctctcgtgagaaagatgtcggcaaacgcaaaccgaaagtttcttctccgaaaaaaatagtatctacataaggtaagagctgttttgcttgttcgatcgactccaccgttgcgataatctcaaccatgatattcctcctctataactcactaatagtatcacaggcaacacggctttccaagacttccttttgaacttttttcactaaaaaaaggaatactcagcgatgagaactggtaatacaactttaacactcttttaaatttgtgaactttatgagtttttatctccagttcaattgttcgaattccaacaaatactatttgcccacaaaaaaactatccaagcagcaaacgatggttcagcctgcattctgctgaccatcagtcgtttgctagttagatagttttatttttctttatgagcttatacttgttgaagaatacgagattggccttcttttacattcaatgtaattgagcctttcgatgccccaatcgtcacccggtcacctaaatggatttgtcccgacaatagtgcctcgcttaagcggtcttcgacctctttttgcaatgctcgacgaattgggcgagccccatattctggatcaaaaccagctttaccgatgacatcaatcgctgcagatgtgatcttcagttgaatgtcttgatcactgagacgtttgatgatcgctttactcatgattttaacgatttcatgaatttcatcttcacctaatgaacggaagacaactgtttcatccacccgattcaagaactcaggacggaatgctttcttgagctcttccagaatccgtttttgcatcgcttgatggtctttgctaagatccaccacattgaaacctacattcttttcttcacgaatctgttgtgcgccgatatttgaggtcataatcaggattgtattacggaaatcgactttccgccctttggcatctgtcaaatgaccatcatcaaggacttgtaagagaatattgaagacatctggatgagctttttccacttcatctagtaaaatcactgaataaggttttgaacgaatcttttcagttaattgtccaccctcatcgtaaccaacataaccaggaggggatccaatcaaacgacttgtactgtatttctccataaactcagacatatccacacgaacgagtgaatcctcactgccaaacattgcttctgccaaggcttttgccagctctgtttttccgacacccgtaggacctaggaacatgaatgaaccaattggacgattcggatcttttagaccactacgtgctcgacgaatcgaacgtgcgactgctttcacagcttcttcttgaccaacaactcgctgatgcaggattttttctagatcgagaagccgttcactttcttttttctccatttgctgtaaaggaacgcccgtccattgcgacacgactgccgcaacatcttcgccagtgacactgtctgcgtagccggaagcttctttcacttccatgaatgcaacttcagtcaactgctgggtcaatttcttctctttgatgcgcaaacgagctgcagcttcaaagtcttgttggcgaatcgctgcttctttttcttcaatcagattggcgatttcattttgcaaatcggccaactcagaactttcgtctgttttatccaagcgcacttttgctgccgattcgtccatcaagtcaatggctttgtccggcaactgccgtgaattgatatagcgtaccgacaattggacagcggcatgcagggcatcatctgaaatctctacgccgtgatgctcttcataacggggacgtaatcctcgtaaaatttcttctgcttcttctggcgttggctcatccacttgaacacgggcaaaccgtctttccaatgcagaatctttttcgatatacttttgatattcatctaaggtcgtagcaccaattgtttgtaattctccgcgggctaatgcaggttttaatatattcgatgcatcgatagcaccttccgcaccaccagcaccaatcagtgtatgcagctcatcaataaataaaatgatctgtccatcttggtaaatttcgtcgatgattttcttcattcgatcttcaaactcaccgcgatatttcgtgccagctactaaagcacccatatctaacatcattaagcgtttgttctgcatatcttctggtacttcaccgtgaatgattttttgtgccaatccttcagcaatagctgttttaccaacccccggttcccctactaaaacagggttgtttttggtccggcggcttaggatttgaatcaatcgtttcacttcttttgctcgacccactactggatctaagcgtttatctcttgccaattttgttaaatctcgagctagtgagtccagcgtcggcgttccttgtgcttttccttgaggacgacgacgacccgcaccaccggcattttttgtgtcattgatacccatttttttctttaataactgccgcattttagccaaactcaaacctaagttcaacatgattcttgaggctaaaatatcttcatcccgaagcaatcctaacaaaagatgctctgtgccgatttgaagagcgcctaaacgcttagcttcatctccagcgtaagcaaatgtttgcttcgctcgtggggaataggctagataggcattctctggatattggcgaacagttccgtaacctgttaaatgctcgatttcttcgcgaatatcattttcagtgatattcatttcccgtaacgttttgccggcaatgccattttgttcaatgactaaggcaagcaagatgtgttctgaacctacggactgatgtttaaagtactttgcttcttcctgtgcgatcgtcagcacagctttcgctcgttgtgtaaatagttcatccatctcattcacttcctgtcttcataacttaaacgttctaaaattgcatggagcaagtctgctcgtgttcgattttcataaggagaacgtcctaatactgacttcgcaatgacggtcaacaataaattgccctcacgcttcgacaggattccttcctcataaagtttttggattattgcataagcatctttttccgagatggtttcatcaaataattgattcatttcttcaaggtagtggtggttatccgtgatctttactttttcgatacggatatatcctccgcctccacgtttgctttcaacagtataccctctttgaatagtgaaacgggtattgatcacataatttatttgtgaaggcacacaattgaataaattcgccatttcagctcggcgaatctcgattgtttcgctgtcttcaagaattttcttcaaatatgcctcaatcaaatcggaagtgttatgatgattcaattcattccctcccttgactaattctgaccttcattatacccaatttttgaaaacttgaaaagatgtacgcctagagatgcggaattactaaaagaaacttaaacagctagctcttttttcgcatcacaaaaaaactatccgcatcttcaagtggttacttctacagtctttggttgccatctcactgcgacctatagagtaaacttaaaaatcattcggatagttttttcagctattgattaatcttcagagctcgttgaactcgtacttgttgattcactgctagcggaggattcactcgtagaggactctggttttggtcctttagaaatagtaacatttactgaagaaccaacagccaccgaagtcccttcacctggcgaaacatctgtgacttctccagccggaacagaatcattgtagcccgattcttctttgatcgaatattttaacccagcctcatttagtgctgctacagcatcatttcgactctgtccaatgattcgtggcacattaaccatctcttgaccgctgctgactgtcagcgtgataacagtttgagaggtaatgactgattctcctgctcctggcgcttgattaatgacagtccccaccggttcatcgcttggcgctgattgttcataaatattttcggttggaactccttttgaggtcaatgccgcccgtacatcttcgattcgctgaccataatagtcttccattgcaaacgattcaggtcccgtgctgactacaaaagtaatgtcatcctctttcggagaaactttctcgccgacatctggtgattggctaatgatcagaccttctccgatagcatcactggatttggtctcttctttgatttggtcttctgaaaaacctaacttgatcaactcggcttttacatcttcaaaatttttctcttcatagttttttaaggtgattttttcagtccctgagctgatatacaaagtgatctcgctattttttttgacttcggttccttcttgtggatccgttttaacgacattgccttcttcaatctcatcgtcagcaatttcttcggtttcatcagcaacttttaatcctgctgcttccagcttttctcgagcaacggtctctgtgtctccgctgactttagggatctcaacatcgccgcgccctccgccaaaaacaaaatagccgccaatgaccagcagcgctgcaataactagtattggcaggatcagccaccatttcttccgcttcttctttggtttttcttgtttctggtctgcggtctcttctacttctggctccgtcactgccggttctgcaggctgttcagctatcatttcatcggtaataggggtcagcgctcgagtttcatcgtttagcgcatgtggctcccaccttggttcattcaagcgctcaggtgacagggctgttgaaagatcttctcgcatttcatcagcggtcttataacgatcggcttgctctttcgctgttgcctttaatacgacattctctaatgattgaggaacatttttatcatagatacgaatagaagggatctcatcttgaaaatgttttaaggcaattgtgacagcggactcaccatcaaaaggaactttccccgtcagcatttcatataggatgattccaatcgcatagatatcagattggttagtagccatacttccccgtgcttgctctggcgataagtagtgcacagagcctaacatcgagttggtttgggtgatcgatgtttccgataaagcaatcgcgatcccgaaatccgtgatcttaacgacgccttcttcattgatcagaatgttttgtggtttcaagtcccgatgaatgattcgatgttggtgagccaatgccactgctgacaaaatttgttgcacgatatcgacaatctgtagataaggaactgggtaatgggtttgaatatatcgcttcaagtccatgcctttgacatattccatcaccaaaaactgcatcccatcttcttcgcctacatcatacactgttacgatattgggatgaaccaactctgtggcagccaatgcttcacgctgaaagcggcgaatcgcatttttatcattttggaagtcaaatcgcaatactttgacggcaacttctcgatcaagaatcaaatcatgagccagaaatacatttgccatgccgccactgccgatattgccaatgattttatagcggccatttaactttttccctatttcaatcatgggcagttcctccaactttgatcagtaacactgtgatattatcgactccgccttgttgattggctgcatcgatcaactgctgaaccgcttctttaagggacgacgcgccttcaatgatggctgcgatcttttcatctgccaacatgtttgtcagtccgtctgagcaaagaagcaagtaatcactttcagcaaaataatgaatcgctacatctacttctactgtattaggcattccaacagaacgagtcaaaacatttttgcgtggatggttcagtgccatttcagcagtaatttggccagatttcaccaattcattgacaagagaatggtcttcagtaatttgtatcaactcatgatcccgcaaaatataggcgcggctgtcgccaacattcgcaatcgtaaattgatcctcaaagagtgctacagcaatgatcgttgttcccatgccattcagcgcctcatcctcgatgcctttttcatagatcgagacactttctgcctggattttttggatcagccattgagcagccttttcactatctgtcaattctgttttttcccaagcggttcccaagccactcacagcctgacgactcgctacatcacctgcccgatgtcctcccatcccatcagctaagatcgccaatgggatactttttttgttgacatacacagcagcaaagtcttggttcgtattccgacgtttaccaacatctgtttgaaaatggatttccaacttcttttcacctcattactttttgcgaaggcagcttatgaaaaagccatctgtcataaaatcttgcggataaatcgttagcatctgatcattgatattcgcagcaatatcagcatttaccgatacatcgattcgttcgaattctggatgatccgctaagaatgcctccactactgcctgattttcttctagcattatagtgcatgtactgtagatcattatacccgaattttttagcgttggggcggcactttctaaaatcgctaactgaatttcgggtaaacgctctagatcagctgcctgcttgttgtatttgatgtctggtttacgacgcatcaatcctagaccggagcaaggagcatccactaagattcgatcaaactgttgttcctcaaaatgttgagcgacttcccttgcatccatcacttccgcttgaaccacctctgagaccgcaagtctttcagcattttcagtgatcaatttaactttatgaggatgaatatccaatgcagtgactttcccacctgcttctgcagatagaaaggacgcgatatgggttgttttacctccaggcgctgcacaagcatccaatacttggtgctctggtgcaatgtgcagtgccggtgctactaacatcgaactttcatcttgtattgtcaataatccgtcatgatataaagaagagccggctaaaaatcctttatcagccacaatcccatacggagatagttggctttctcgagcttcgattccttcttcctgtagttgaaggatggcttcgttgcgagtaattctttgtagatcaaggcgtccactagcatggctaggtactagtaaagacagccctaactcccgggttttatcgctgccgatctgcgctacgaatctttcagttagccataatggcatactgatttctatagctaaccgctccaagggatctttgatttgatcaagtgccggcacaccctctctttgaatcgtacgcaacacgccgttaacaaattttccgatccctggatttccttttgctttcgcgatttccacggcctcatttaaaatagcatgattaggtactttgtccaagtacagcatttggtaaagagaaagacgcaataatgatctgacccatggatcgactttttttgcattcttgataaagttcgctaaataataatccaatagcagctgccgactaatggttccatagaccatttctgtcaataaacgtccatctttatcatttaaacggccttgattcatcagttctctcaataataagttcgaataggcaccgcctctttcgatacgaactaaggcctctaatgcaacaaagcgaacagtatattggatttttcctattttacgcttcatgagtaccaaccttatcacctagttgaatgtgttgcccagtgccatttagaaaagccgcaatggattgacgaccttttccagctggttgtagctcttctaaagctaaaactgtctgttgaccacaagcgatccatagcgcctttttcgttcgttgtatgatggttcctggcgcggcatctgttgtttcatcgactactgctactgaccaaatcttccaacggctcccttggtaagtcgtgaaagcaattggccacggtcgcatccctcggacctgattgtcgatctcctgtgctgtctttgtccaatcaattgcttcttgttcttgcgtaatattgggggagaatgttgcctgctcttcagcttgaggcattggtttcagttctcctgataggatcttaggtaatgttttcagcagtaattctttacccaataaacttaatttctcaaacatagtccccacatcgtcttgattagtgatcggcagtttagcttgagaaaaaatacccccagcatccatttttttaatcatttccatgatggtgacacctgtttccggttcgccttccatgatggcatagtgcactggggcaccaccccgatactttggtaataaggaggcatggacattgatcgctccaaattttggtacttgcaacagcttttccggtaaaaattggccaaaggccgcagtgactaaaatgtctggtgctaattctttgatcgtttccatttcaggtgaaccgctgattttttctggttgcaaaaccaacaattggtgcttcaatgatgcttctttgacaggcgttggcgtgattactcgttttcgacctacgggccgatccggttgggtcactaccgctgcaatttcatagccttctgccagcaatccttctaagattggtacagaaaacgcgggggttcccataaagacaactttagtcattttcgtgttcctccatatattgttctagttcagattctgggatcttatcgatcattttatcaataaataagacaccattcagatgatcaatctcatgctggatagcccgagccaagtagccaaaagcttgaacctccatttcttctccttcacggtcaaagtagcgaaccgtaatctcatctgctcgcttgaccgtaccataggtatgaggaatactcaagcacccttctacatcaacagattctcctgatgactcgatgatttctggattaatcagttcgaaacgatcctcttcatctacttcaacgattgccacttgcaggtttttaccaatctgaggggccgcaatacctacgccgtcatgcgccaccattgtttcatacatgtcttctagtagttgtaccagctcatctgtaatcatagataccggttttggttttcgacgaagctgatcgtcgggatgaataataatcggatagcgcataatatctcctttaaataaaattcaacggttcttggtcaatggaaacgtagagtccttttcgctgatcgatctgactttgttccaataaccgggtcaacagttcaggcaaatgtggttcatttttgtatttaataatcagttggtagtaatagcgatttttgacacgcatgatcgcgctaggtgccggtccaagcaaaatactttgacccgataattctttttgtacttcttggtaaatggcaaacatcttttgggcagctgcctgctcttcgagatgactgcaggtaatttttaccgtgtagtaataagggggatatccgctttgatgccgaacccacatttcttgttggtaaaaagcttcatagttttgggtttgtgctagctgaatcgcatagtgttccggattaaatgtctgaatgattacttcgccggctttctccgcccggccagctcggccgcttacttgcgtcagcaattgaaatgttcgttcactagaacgaaaatctggcagattcaatgctgtgtcagcatttaagacccctaccaatgtaatatccggaaagtctaaccctttggcaatcatttgtgttcctagtaaaatgtctgctttcttttcgccaaataaagtaagtattttttcatgtgctccttttttgcgggtagtatccacatccatccgcaatacccgtgcttctggaaatctagcaattagttcttcttcaactttctgcgtacctgttccatagtaacggatcttatctgcatgacaactaggacagcggtgagggatcttttcttcatgcccgcaataatgacagcgcatcgtcttggtatccatatgaagcgtcaaagaaatatcacagttcggacaaggcagaacatacccgcaatcacgacacataacaaaagaagaatacccgcgtctattcagcagcaaaacgatttgttcttgtttatctaagcgatcttgaattttttcctgtaattggcgagaaaaggtctggtagtttttgttggcaaattcttcccgcatatctactacattgatctgcggcaaacgagcactgagttttgctcgttgattcaaacgcaacaattgataaacgcctttttgcgcccgagcccgtgactcgagagagggagtggcactccccaaaacaacaggacaatgatgatatcctccgcgccatatcgctaaatcacgcgcatgatatcttggtgcctcctcctgcttatagcttgcttcatgttcctcatcgacaataatgacgccaatgttttttaaaggagcaaaaatagctgaacgtgcgccgactactacttgggcttctccccgttcaatttttcgccattcatcatatttttccccttgtgacagtccactgtgaagcacagccacagcgttacctaagcggctcttgaatcgttccaccatttgtggggttaaagcaatctctggcaccagcataatggcagtctttttttgttccaaaagctcagcgatcgtttgaagatagacttctgtcttcccactgccagtgatgccttctaaaagaaaggtttgtgcctcttgtctttttgctgctgacagaatttttgaaaccgcatcggtttgttcttcgttcaatgctaatgctgcagtttggggaaatgatcgatctttgaaggggtcccgatatgtctcaacctcatgaaattcaagccagcctaatgcttgcccttgattcaagacagctgtcgaaatgcctgcttctgcaaaaaatgaaacaggaagctgatcagattcttgtaagactgtcaatagttgttgttgccgtttagcccctttcctgatttgcttcattgcctctggaattgcttctggagagatcaggcgtttcaccatacggattttcttggctttatttttattttttaccacatattgcaattcaacgactgcttcttcacgcaatactttcaattgcgacaataatcccgcttcctcagcagcttgccagctcaggctattcgtctcaggaaaatgcgcttttattgggtgcgtatcatccaataaaagaatattcttctggtattctgctttcatcacactaggcaacatggtctgcaagcaggtaatcttaaaagcaaatgtcgtttttttcatgtaatcagctaactgtaataattcttcattcaccacaggagaaagatccagcaagcgaagaataggtttcaatggttgacctggcggtgtatccgtcaatcctacgataaagccttggatatgccgatccccattaccaaatggcacttcgactcgcatgccagtctctgctacagcgcgcaaatattcaggtatttcatatgtaaaaggttgatctgtctgcatcgttggtacatccacgatcacttctgctgcataggtcatcttctctcctcctccaggctttattttactaaaatgacagacatttgtctgtaaaccttacgaaaatttaacggctatcgactcaaaagaaaaagccagaacacgcattgtgctctagcttttttaattgtctacagattctgttcgtcacgaatccgggcttccagttctttttgctcttggtctttttgcgctttgcgctcttcttgttccattttcaagcgagcacgtttgatttctggatgcggatcattaacaacaagctctgcttcgatttcttccaatgcttgtcctacgcttttcaccgaatcaaattgttccaatgttgcttgggcgcctgcatctagttcatgcgcgcgtttgctggctaaaatcacaagggaatactttgagttcacacgatccaataatgaatcgattgaaggttttaacatcattcgttttacagctcctctaacattttgatatacttgccgattactcgatcaacgcgaaaatgttcacttgatataatttctcgaatccgttgtactgctttagatacttcatcatttacgactgcgtagtcatataaagccatcatttcgatttcttctctggcaacacgcattcgttcatcgatcacttcagcagaatctgtccccctgccagtgatacgtgagcgtagctctgctaaatcaggtggggtaagaaaaataaagaccccatcaggcacttcttctttgacttgtttagctccttgaacttcgatttccaagaaaacatctttcccttggtccaatgttttttgaacataagacaacggggtgccgtagtaattgccaacgtattctgcatattccaacatttcgcctgcttcgatcaaggcttcaaattcctcacgggtgcggaaataataatcaacgccttcgatctcaccttcacgcttgttgcgtgttgtcatcgaaacagaatattgaaaatcgttgtcatcactttcaaaaattgcttttcgcacagtgcccttgcctacaccggaaggtcctgataaaactattagtaatcctcgctctgacataatgacgtcctttcactgacttttgcttaacgtctattttgcactttttttcagcaactttcaagaactactttattataatgggaaattcatgaaattactactcatctctcctacttttagaaccccatgttgcttagcgtattgatcacacctgccaactcatcttttgtcgtgatagctttctccgtaggatcttctacttcctggcaatcaatccgaacgatataccgacgattcaacgataccgcatttccattgaccaaaatttgcaagaactcttgatcaatcgcgacacaagcatcttgccaagcatcaaagtttgctttatctgatgggacgctccgcttgatgacgttttttccgcttaattcatgaaaagtaatatcatagtatttcattgttgatcactcctattcgatattttggacttgttctcttattttttcaataatcgtcttcatctgtactacactattcttgatttcaattgggcttgacttggaacctatggtatttacttctcggttcatttcttgaatcaaaaaatccagctcccggccgatcggcgattttgcctctaacaaagtagtcatagaatctaaatgaatcatcattcgatccaactcttcatgaatatctccccgctccaacaggatggccatctcggtcaacaaacgttcttgatctacttgctcgcctaaatattccgtcagctttttctcaaaacgttggcgatgatcggcttcataaacggcaataaacgtctgtaattccatgattttaccaagtaattgctgctgattttcttttaacacttgataaatcccttgtccttcaatttcacggctttgatcgatagctgttagagcctgagacaaagcatctaacacaccttgctctaactgggtatcttcttgttgtttttctcggatatcaagaaatgcttcatggacgattaatttttccaaaagattttttttcgacagctcttttatatccaacctttgagcagcttcttcttcgacctgcttcaaaaaaggcaccaataaatcccattggactataacttctttatgagccgcattcttttcgttcaatgtcagataaagctccacccgaccacgctgtaatacttttttgacttcttgtcgaattagtgcttccaaatcattcaattgtttgggcatgcgcaactgcaaatccataaatcgctgattgacacttttaatctcaatctctatttgataatcagctgtttctccattcccttttccaaaacctgtcatgcttttcattcatttcttcctttcacatagaaagcagtgcttttttcaattcggtgaattcttcatttgataacgttaagcctttacccattttttcatgtcctggactccagtcacgcaagtcaaacttaggcgggcgaccattccagctgactaaattaagctctttacgccaccctttaggattttccgaaagaacggcgatctcctctacgatctcataagaaaaattatccattgtgttcctctccttttaaaaaataagccagataggctgacagcacagccaattctggataccgcgcacgaatctgctgaaatgccggtgtttcaatttgttgggttcgatagaaaaacaagaaccgtttttgttcagataacaaaaagaactgttcgcgatagtaatacaaccattctgacactgaccatacttctgtttctttcgttggttctgccatgattttctcacgtatcgcttgcaggaaagattcctttgtataaatgacggtcggtgtaagatgtagtaatctgcctatgcattcaaaaaagacgcgcccacaaatttccaaggggacctcttgctgatataacttacgcactttcttccaaaattccttttttttcataaatgcgtacaatcgcggtgcatcttgtcgaagcaaatgaacgaatggcttccacgaatcgttgaagacctcttcatcaaaagtataccaatagccactgaacttgccaaagtatttcatcgtttctaaatacccaagagtcatgttttctagagaacgtttggcatcaaaaatcaaaaaactacctagagtccaaggtgaagcaatttgaatctgcgcaattgattctgagacctgaaccttcttattgattccaggtccttggacatcgacggcaatgacttctgtagcgcctcgctcaatggctacatcaattggcagattgttgcggtaccctccatcaatataatagatcccatcaatcaattgtgcctgcattgctggataaaaagacgctgatgctagcaaccattgcaaactataatcaattttgctggaatcaaactgataaacaacctctttgaaatccggcagacgagtcgtacaaagtaagagctggcttttgctggcattaaatttttctgcatcaaaagtcgctgctaacagctgtgctaatggttttgtactcgcaccattgtctttaagtgctgtctttacgagtgagcgtaattgctccatcatatctaataaggtttcttttttagcagcagcttttgggtattggaggacctgttcactagaaatattcgtccataattgctcagcagcttcaatatcgtccattaaaaccaatgcaccattcaatgcaccaactgacgtccccgctacccactcaaatatgattccatgttttttcagcgcttgccatacgccaatttgataggcgccatgggcgcctcctccacctaggacgaaagctgtatggtagtccagttgcttgtggtacccctgtgtcaccctaccatatccacgtcccacaaaccactgatccatgatggggtttcttgtcatttcccaaagtatctggtctacgaaacggcttctagcaaaactctcagtcatcgaaacaagtgtctcccaagtaaatgcatcacttggcacctgcaacaaattctgaatggtcagaagcggcccttcatggacacaagacagatagactgtgccgtgttgattcgtcaatcgccacccctgttcgttgaccactgattgaaaagcggctcgcgcctccgaatgactagaaaaaaaagggaaaactagtcggctttgttgaaacacatcttgggatacatataaatcagaaaaataaatttttgttgtcttcatccgactcctcctcaaatgcaaaaaagaaaccacggatgatcaatgaaaatttctgacatcattcgtggtattcttatcatttaaaaagtccgctgttccatattgaatgcggcccgcatctcgtctgtcgcatcagcaactggtgtaaccgattcaagatcaccctgaaccacacgtctggttactccacccatttcaccacatgtaattaatgtgatcatttttctccctgctacttcatccaataaataaacatctgttggttgaacccgcacggttgaagttgctgtatatgtataaatattttctaaatccgtaatataaattgttgcgccaatagccacatcatctaaaggtgtgaacaaaaggtctggcgactgcgcacgatggctagctagtgcataatttccttcgcccattttttgtgttgggctaagagttcctgctccatatagcaaagcttcattcgataaccccttaaaaatcggcaaattaatcgctacgctaggtatcgcaacaccaccgatcactggtaatgtgctgttacttagttgcgctttaagaactgcttctgagctggccggttcaacggcatcaaaatcaaaagtagtatctgcctccatattttttttgacatcggctctagagatctcggaaactgcgtaagcatctccgttgtgtttgatcagaaaatttttgatttgattattaaaaatcaaagcaagaccaatcaataacaaaaggaccaaaaatagattcgagagccaatggaacaaagttcgtttctttttcatcgtttttcgtctccaatttttattactcctatcataacaaaatcattgcagaagcgccaattttggattttttttaataaaaaagcaaagttttttgcttcataaaaaaacgtaatcttaaaaattgttttttccgttattttgtaatataactttaaacgaaaagatacaagcaatttgatacactttattgtagaatgaacttattatcagggagggattaattggcatgtcgaacacgatttatgtacatattgatacaaccagcaatgccgtttcgactcgcggagtggatgctcaagatttcaacaagagcatcgttcaccagccaaaaaatctgttgttgcttgatccctctagtgaatttggtgaatttgagtcgcatacagggctaaagattatccgaggcattgaagatgtccaccttttctttcaacaactcaaccgcggacggatcacagaagaaatcaaatggatcgactttaatgatttagaaatggtaaaggagctaacaccgctagaaatttcagaattgttatattttgggcatatgaaaacgcatcttcattctccgtttttctacaaactgcaaaacaactttgtttatttcgacctcaaagatcagcgttcccgtgtttactaccgctacctggaagaatattaccgaattttagctgacaaaatcacgcacatcgttctagaaaaaataaatgatcgactttctttcttcaaaaagcctactccggtctctaaacttgatttaaatcttctcaaagacttgcggggggtcatgcaggaaggaatcatcttatgtttccatcaagaacaattggtcgataaaacctacacaatcccgatttacttagtcgaggaatctgggctcaaaaatagtcacctctctctgaaagaagactatcaagtggcaacgcttcgctactttgcaaataaaaaagaatggcagttggaattggatcaagatgatctagcttttggttttatcgataaaaaatgacttgctctcctattttgattttggagaacaagtctttttttacgcagtccgatttaaataatcgtccttaggtacaaatacctctggggatgttcgataagcaattagtaagataattgccgtgacgattgccgtagcaagtccgctggcggtattcattaccagagagaaaagccaaggtttcatcccccagagagcatatgcgccccagtaaacccaaccggcaaggaaatgccaaaaataacgagcaaatgcgcctgtgaatgttgcttgtacaagtagtcgttgcacgctacccttcgaaccatttctaatcgccaaatgaattttatttgcataaagtccggcaaaaccaacaaatgtaaaagcaaatgggtactcaatcaatacttgaagaacactcaaaaaccagactttacctaatgggaaatgcagcaatccccaaaccaatccggccattaatcctggcttccagcctctacggatagcaaatattgttaatggaatctgtcctaaagaaattgaaaaactacttccaaagtctaaaggaatcagcgatagtaccatcgccagtgccgccataatcgttccctctatccaaatttttgtaccatttcccacaaaaaaactcctcctttagaatcatcacaattcacaaaggagaagtgttagacacttcaactcgtcacaattcctacgttcgcatgatcgaaacaggtacgaagggtttagagtactctcattctcagccttttcagactcccctttgtgattagattctattttattttgcttgcactgctgcaagtcatcttcaagaataccacaaaataaaaaaaagaaaagaaaactcgctctgataaaaaaagaaacatctcaaccgcgtctagacgagatgcttcttttgggttatcatttttaaatcgataattttgattcgaacagtggactaacaggtttattctcatggattcgtttgattgcttctcccatcaatgcactaacactgatttcgtcaattttttcagatttacgatcttctggcaagaaaattgaatcagtaactactaagtgctcgatagctgaatcttcgatccgttgcaaagcaggtcctgataaaacaggatgagtacatgaagcataaacactttttgcaccagcttgttttaatgcgttcgctgctagagtaattgttccggccgtatcgatcatgtcgtcgatcaagacacacgttttgccttctacgtgaccaatgatattcattacttcagcaacatttgcttttggacgtcgtttatcaatgatcgcaattggtgatttcaagaattctgctaatttacgcgcacgagtcactccgccgtggtctggtgaaacgactacaacgtcatctccttgaatatctctttccaagaaataattagcaatcaatggtgcacccatcaagtgatctacaggaatatcaaaaaaaccttggatttgtgaagcatgtagatctaaggtaaccatacgatttgcgccagctttttcgatcatgttcgccaccaatttagcagtgattggttcgcgggaacgagctttacggtcttgtctcgcataaccatagtaaggcatcactacattgattgttttcgcacttgcacgtttcaaggcatcaatcatgatcagtagctccattaggttatcgtttactggactgcttgtggattgaataacatagacatgtgaaccacggatactttcttcaatgttaacttgaatctcgccatcgctaaattggttcactgaacacttacctaattccacacctactgcagctgcgattttttcagctaacggacgattagaattcagcgaaaaaatcttcaatcttggatcaaaataatgatttgacatgagaacctccactttctttgcgttcatctggcaaaaagactactagttcaccagaatcttcttcctagtaaatagtagtcatttttgctaaataaatcaagtcatttcgcagtttcttcattcaaataaggcaatttttttgcatagccttctttgttttcctgccttgctcgggcaatcgccatgctatgtttaggaatatcttttgtgattgtagagccagcagcgatcatggtttcttcctcaatctgcaatggcgccactaaattcgaaccagagccgataaaacaattgtctccgacaactgtcttgaatttatttttgccatcataatttacaaagacgacgccgcaaccaacattgatatttttccctagcgttgcatctccgacataagagagatgccctacttttgttccctcaccgatcgttgcattttttatttctacgaaattaccaatatgggctctttctttaatgtctgcttttggacgcagatgtgcatttggtccgacatctgccccattgtagattcgactttcttccaccacagatgccttgatcgttacatcatcaccgatttgactgtctatgatttgagaagatgcagtgatgacacagtcttcaccaattttcgttgcacctttgatgacgacaccagcttcaatcagtgtgtctgctccaatttccacgccatcatcaatataagtagtatcagggtcaatcaatgtcacaccattgcgcatatgctgctgattgatacgcttgcgcatcaaacgattcgcttctgccagcgctaatcgatcattgactcctaacgactcattgaaatcatccgtttgataagcagctacaatcttcccttctgctttcaagatctcaataatatctgttagataatattccccttgtgcattatcggtatctaattttgccaatgcatcaaataataattcattgtcaaaacaatacgttcccgtattgatttcttggatcatcgcctcttccacagaggcatctttttgttccacgattttttctacgacacccatttgattgcgtacaatccgaccatatccggtcggatcttcagcttgcgcagttaaaatcgttgctgaggctttttgttcctgatggaactcaaaaagattattcaatgtctcagtcgttaacaaaggggtgtctccactgattactaacgttgttccccgtttttctcttaagaaaggctctgcttgaacaactgcatggccagttcctaactgttctgcttgtaaagcatactcactgcggtcccctaattgttgcttgaccatttctgctccatgtccgacgattgttacgattgcatcaggttctgtctccactacgcgattcatgatatgttctaccataggttttccgcaaacgggatgcaaaaccttgtataacttggatttcattctagtacctttgcctgcggcaagtataattgcaaaacgtgattccacgtgttccactcctatcgattccgactgattgatttctgtatatgtccagtttagcccaactaaggatggttttcaatatataaggaaaaacacaactagaccaattaaaaaagactgattcaaaatcagtcttttgtttcaaaataattccccggcacgaccgagatcgttttcgtctgagtatcaacgtcttcaacaaacagcagcgaactataatcagaaatagcacgttttcctttgaatttagcttccgcaaaaaccgttatgccaacaagttcagcttcaaattcttcgatcaagctcttcataccgttcacagtgccgccgcctttcataaagtcatctacgactaagactttggaaccgcgttttaagctacgctttgataattccattttctcgattcgttcagatgacccagaaacatagttcacgctgactgttgacccttccgtaattttagaatctcgccgaacgatcacaaagggaacatttaaataataagataccgcttgtgcgattggcactcctttagtagcaacagtcatgactgcatcaatttgtttatccagatacttcgaagcaatgatacggcctacttgccgcagtagctcaggttctccaagcaaatccgagagataaacgtaaccaccaggcagcagtcgatcttgctcagaaaggcgttccgctaacccttcaacataggcataggcttcttcttttgaaatctcaggcacaaaaaaaacaccgccagctgcacctggaattgtatcgagagttcccgtaccacgttctttgaaggtctttttgataatcgctagatcttcactgatcgatgatttagcagaagcatagcgttttgaaaaaaatgacaatgaaatcaattcatgcggatgattcaataaataatgtgtcatatctatcaatcgttcacttcgacgaattttcacacatgcccactcctttaatttattcgtcttattataaggctttttgcgtataaatgcgagcattatcttgaaaatctaaagaattgttcgcttttcattcaatcaaagaaaaaaagaaacgaaaaattttcgtttcttatcgttttaaccgttgttttcgttggaaaagaatgacaatacgcttgaccacattgatgactaaaaacaaaccgataaatactaatgtgatcgtagcgcctggaggtgtatcgagataaaaagagctagtcaatcccgacagcataccgaatagaccaatcaagacactgatcaaaatcaccgcattaaaactcttgcctaaacgcatactgattgcagctggcaataccataatcgcagaaatcagtaacgcaccagcgatgggaatcatcatagcgatagcaatccctgtcaaaacattaaaaagcatcgacattatccgcactggcaaacggtctacatgagccgtatcctcgtcaaaagtcaggacatacatcggacgtttgaatagaaagaagagaacgaatacagctaaaaataaaaagcctagaaaccaaacttgatcctgagtaatggtcacgatggaaccaaagagataggattggatactggtcgctgagtttcctccactcagattcataaggaccaatgctaatgccaaaccgcctgacatcaaaatcgcaattgagatctctgaataactccgataaagtgttcgtaaatattccaaaatgaccgcggcgatgattacgattaataaggtcgtgagatctggattcaaattaagaaaaaagcctaatgctacaccagctaatgaaacatgtgagagtgtatcggccatcaaagactgtcttcggatcacaagaaacacacctagcatcggtgcgattccggcaataaaaattgcagccaaaaaagcacgcctcatgaattcatatgaaagcaacgccatggtgaatcctcctttcgaaccaaccgaatttgtcgatccgcatactccttaatatcttcgtgatcgtgggtgatcatcaaaatcgatttcccatgatcgtgtgcattgtgacgcagtaattcataaaataaatttcgtgattgctcatccatccctgtcgttggttcatccaaaataaataaatctggatcagtcgcaaagatacgtgctaaactgattcgctgtttttgccctccggacagttcgccaatccgttttttgcgcatttcccacatacctactgcatccaatgctcgccgaacatgttcatgatcccgctttgtcagcttcttaaaccatcggtctttcggataacggccagattggaccaattctaagactgtacttggaaagcctacattgaacgaggcaatctgttgtggaatatagcctacacttagcttttgtccttctctgtttttggtagccagtattacttctccctttgatggtttcaacaaccctaatgttgctttaatcaaggtagattttgcagccccattttctcctgttagaatgacgaattccccatcttcaacaaaataagagatatcctctaatacaggctcatcatcataataaaacgttagtccttttacatcgatataacgcacagatgtgcctccttacttgatacttttttgtaaagcttgcagattttccttcattactgtgagatatgtttctccatcactaatctgtttttccgtcaaactttctaacggattcaatacagccaattcaaccccagtctcattcgctaaagtttccgcgactttagaagaagcattttcttcaaaatagataactttgacttgatgatcctcaacatattcttttagctctgctaaccgactaggagttggttcttgatctggagataatccagcaatcgattcttggactagatcatattgttttgccaaatatccaaaagcggcatgttgtgtgacaaatgttcgattgaccgcatctttcaaagcagcagtgtactcttgatccaatgcgttcaattgctcaatataagcagcggcattctttttaaatgtagctgctttcgttggaaatttctcgcttaactgatctcgaatcgtttcaacttctttgattgccattactggatctgtccacacatgcggatctaattcatgggtatgggcgtctgtcccatgttctgcttctgcttccgtttctccatggtcttcattttcagctaaatcaatctctttggccgcttcgatcacaactgttttgtcagtatcgatcgaatctgtcattgttggcacccatgtttccaattccggactattgtacacaaaagcatctgcatccataatttttgccatatctttcgcactaggttcataatcatggggttctgtgcccgccggtataagcaaagatactttacctgtatctccaacaacctctttggtaaactcatacattggataaaaagtcgtaataacctgcaaatcctgactttcttctgcgacttgttctgatccttttccgcaagcccctaataaaacagtactggtaagcaaaaatagagctagtaattttttcatgatgattcctcttttcttattaaaacggaactaatccgatttatcagcaaaaattactctaccaaaggaaacctcattcgtcaagacaaatcgtatgttttccgatttagggcgttcctctgccagtaaatcggaaaacatgggaaaattgattcatatatccgctaagcaaaaaacagatgtcacattttttgaatgtgtgcatctgctttttaatttgtccttttgtttcctactattttaatgtgcgaactagataaacctcttcacaaaaaccttttaaagcattatacactcgctgagcccgtgagtatttctggcacaaggcaaaaacagtcggtccacttccagtcatcagtgccacatccgcaccatatttcatcattcgttccttgatttgttgtacgactggatgcttaggaatcgtgatcgattccaaactatttcccattgcagcaatcattcgttgataatcttcagcaagaattgcatcagaaagttcttgaatatctggatgatgcaactgatctagatcaacttcttgaaaaattttacctgttgaaacacttagtcggggcttgactaagaccacccagcactgcggcatcgggcgcaacggcgtgactttctctcctttaccagagatgaacgcagtcgttccataaatgcaataagggacatcagtacctacttccattcctatatcgatcaattccggcatcgtcagacctaattgccataagcggtccatcccccttagcgctgctgcacaatctgtactgccaccgccaaggcctgctgctacagggatatttttcgtgatccgaatcaagatacctttattgataccatagcgttttttgacaatactggctgcttgatatacattattgcgtttatcgatcggcaagaaggccttattggtttcgataatgattttatcttcttctagctcttccattatcagacggtcggctagatcaacactggacatcaccatttccaattcatggtaaccgtctgctcgcttacccaaaacatcaagtcctagatttatcttagcaggcgctttttcaataatttccatcttattcacccaatcatctgatagttaactagttctatcatagcagattctttagagatagttgagatatttctcctgtttttgatctttatcagcttttgggttgctctttgaaatcgttcctcgtaaaataagagtaacaaatttgatcaagaaggcaggggaaattatggcaaatctaattcctagagatctacctggtggagaagaactattaggcaaattgatgaacagtttctggcaagaacgacaaatgaatacagatattaaagaatatgaagatcattatgtagtcaaagctgatcttcctggtataaaaaaagaaaatatccgtgttagtttcgtgaatgatactctaacaatttctgcttcccaaattgaagaaagcgaagagaaagatgatcttggtcactacttgcgtaaagaacgatctagcagtgcttatcaacgtgcattcactatacctgacattgatgaagaagcgatcaaagcacggttcgaagatggtgtcctttccttgaatttaccaaaggcaagttacaaagacgcgccaggtaagcatattccaatcgaataattgaattatcgcaaaaagtaaaaaagacttcagaaatatcagtttctgaagtcttttttgttgtatttctaccttgccttaccagtttgacgataagcttgtcgagttgttgctgtgggtatttcttcttttttgacataaagcttcaaactataaggttcatgatattttacatcatttttgacaaaatctccgccagtaatgaacaacccaactggttccaaagctttttccccgttccaataaatacggccaattgttgttaagtcactatagctcgtaccaatttgcaacgagtattcagaatctgaccgttgtttgacaaagtagtagggataaagggtatttttaggaatcacaaatccttgtgcgatagcattcgttgctaattcatcttttgaaatgagtttctgtaaatagtcagccaataccagttgatagtcttcttcaaaatcaataactgctttctctgttgataaacgatcgatttgtgtggtgctaattttttctccttcaatattgaatacttcatcaggtaaatacttcacaaaaagctgagtaatatctaccttaagatttttatcaaaaaagtaataaaaaatatttagaacccagaaatagagcaacacgcagaatcctatcccgtataaagccatctgtaaataattttgattgagatagagaccataaacaatacgcagaatataagccgttggaatcaaactaagtaatgtataggcccgattcaagtatttaggactaatatccagataacctaagaacttatgaatcccattgatcatatctaataaaaaagtcatttattcacctactcattttcttgatcctcattgatgactgcttcttggtcagccgcattctgatcctgacttgacggcgtcgtttcctcgctttgcccgttctctgaagaagggacatctgtagctggtggtgtagagctatcctctatcgaagatgaaggaacagttcgctgattatttgttgtggaagatgtagtgcctccatgatcttcagctgatgttgaaggttctgtgctttcagacacaggttgactgtctaccgattgcgagtgactaacatcgctggtttcggtcgtttcagtaatctcagtcgagtgactagttccatttgactgccgatagctactggaattcacaacaccagttgcagtagcgatgatggttgaaatggtcaagagagcaattggtttcaaaataggaggtacttttcgcataattttccatccttgtcttgattcttatcttttttgcactcattgagtacttactttctttatagttctttccttggaaatggtcaagactacgaaggattaacggaacagatttaaaaaaaagtaaaaatgttttcggttacaaacaaaaactagcttctgctaggctctaaataagaaattcgtaaaacttttgtacagaacgagttaacgcagagtgataatccactatcagctcttttaataagatcgattcttgtagctcaaatggctcagtcaattctaaagtgatccgagcaccgtcgatgaaataagcataggacagttcatcatcagacaattcggctagttgattgctccactcttcgaagaatttctccgcgagcacatctccaacttcctcaagaacaggttggagagtctcttctacttgataaaaaggtcgtgacaaaatagatgccgttgtctttgagtgggttgtattttgaaaatccaaataaagcaagtcaatgtagtcttcttcttcacctgtttcttccagccatagaatgccttgcttgaccaatgagacacatgtagattctacttcctttgataattctatagtagcatctttgaacctcagattcttttcgactatttgctcttcacccataaattgcaagacagctttttcaaaaacgagcggctcatctgtaataaataattgaattgttgccatttttttctctctttcttttttatctaatttatttttgctctaaacagattatttgtcagcggtatgaatcttcgttagcatagaaattgaagatgaataaaagctaatttttaaggaggagatttgatgagtaaaattgccactatcattaccgatctagttgaagatattgaagtaacctcaccaaaagaagcactggaaaatgctggacatgaagttgtcattatcagtaatgaaggcgtggacactgtcacaggaaaaaaaggaaccacttttgcagttgacgcgtctattgatacaatcaatttttccgattttgatgctttgttgattcctggtggcttttctccagaccaattacgtacagatgaacgctatgtcactttgaccaaagagtttctgacatctgaaaaaccagtttttgctatctgtcatggacctcaactctttattcaaaccggattgacaaaagaattaacattgactggctatgattccattcgtccagatttaacatatgcaggtgctactgtcaaagatgagcctgtggtgattgacgacacgcatcatttgatcactagtcgtaatcctgatgatttggatgcatttaatcaagccattacaacagcacttgaaggcaacaaataaagcctaaattttaaacgaagaactcacaaatagggtgtacgaatatcgtactccctatttttctatcctttagcgattttacctgctgtttttgttcgcaagttcttttaattaatatttctattcatccatagaaatgtcaaaaccatcaaatgtctcaccatcataatatttaagtaattcatcgagtgatagcaaagaagaagtcatctcctcttcttccgtttgttggtgtttttcccaatagatctgataggcttccgccaattgtcgatagacatctttccgtgaaccaccttctgcctgcagcattggcaattctcgaataaacgcactataacaaggacgaccatcttgccaactgataggtaattcaatcacatgtagttgggcttcttcaaaccatctctccatcccgatccctcatttctccctttattatcacgtgaatgattcagaaggtcaaacttcctgtcaaaatagactaaaaaacactggctaccgatggcttatccatgatttggaatagcaatcggcagccaatgatcatgcagctacataagcatatttttcaatgttttgtttgatcttctcaatgattctctgatcctctacacctgtgacttctgtgatcacttgagaaagattagctgcttccaataactctctcaattgttgactttgctcgtcctcaggatcatgatagttgaaaatcataccaatcgtttcatagagatggaacggttgcacatttctcatttgcaattcaaggacggggcggataaatcgttcttgtgcgcttaattttcgcaaaggggtgcgggctactcgagcaatagcatccgaaatgtagttatttttgaatcgttgaataattttttcaatatactgttcatgttcatcaggatcaaaatcccatttggcgactaaaagttgaccagtttcttctagaacggatttcagctgaatcacaactagatggtcacgcatggcttcatcgatggtctcatagccttgtagagctcctgtataagctactgtagcatgacctgtgttcacactaaacaatttacgctcgatataaggtttcagatctggtacgtattgtacgccttgtagacgaagcactgatttcattgctgtttcttgaactacccactcacaaaatggttctacttgaaccaacaaaggatcatcatgttgttgcatcggaacaatgcgatccactgctgcatctggaaaaccaacactattctccaggtaagcgagttgttggctatacttttctacttcctcttttagaaaagtggatccaccgatcatattttcgcaagcgatgacatcaattgcttgctcctttttcttgattgctcgctgatccagcccttttgcaatgagcggtgcaatgcgaggcaatactgcaggaccaatggcagtggttaaaatatcggcttcgacaattgcttgaacaaccgcatccggttcttttgcgttattgattcctgtcacgtgttcaataaaaatctgttcgcggttctcatctgctaattcaattgtataggatttacgttgctgaagcgcagcaataatcgtttcatttacatcaacaaaggttatttcaaaaccgtttgctgccaaaatctctccgataaaccctcgaccaatattccctgcaccaaaatgaactgctctcatctttttcccctcctatgccactgttagattagcggcgacttcttctttgctcaaagcatccgctaattcgaccacattatcgatatcgctacagaagagagcgatttgttgtaccaactgcaaatgatcttcacctattccagcaatgccaaataataccgtaacgattttttcatcctcatctgtcccgaaatttacgccttcaggcacttgaacaatgcagataccagattttttgacatatttttttgcttcatctgtcccgtgtggtatagctatgaaattccccatgtagacagataacattgcatctcgttcgatcatagcgttgacgtattccggatcaacatatccggcctcaacaagttttttcccacaataacgaatcgcttcttctttgttcgcaaactgttgattcagctcaatcatttctttttctaatagtttcatttttcttcctccttaaagagcttctttaagtgttgtgattacacgctggtagtttgacgttcgcatcaaattgctgacagatagatggactgcatctggtgctagcgaccgcgcttgctttgtcagctcttctttggtaattaccaatgatgaagcatccgcttttagattatcgatatgaacctttttaagtgataaagagagagattctttcgctaataagtcttgaaaaacctttctcgccatggtcgctgagccttcacgatcgtcatgggcaagaataacttcatgaatgccctttaattcctctagaggcagtggcttataatttactgctttcgtttttttctcttcctcaactcctgagcctgacaatgtggccacgatctcattatatttaggagaattcaaaaaattttctacagcaacaaatgttgcatttggtgcttttaattttgcccgctcttgtaactctttttgtgtcacaatcaatgtatgcgcatcatctgtcagattattgattgcttgattagtgacttgttgagccaaaccagcatctttaactttcttacgcaaaatggaagcccccattgcacttgaacccataccagcatcgcaggcaaaaataatcttctgaatgcctgttaacgattctagagccactccttttgaacgctgttttgcttggtgtatttcctgtaccttctcatcaaaattatctacagtgtctttggcatcggcttttagaattgctgccgccacaagaaacgatatggttgctccaacagcaatccctgctaaaacagagacgacactcatcaccgaattcaacggtgtcatcgctaaaatagcaataatcgaacctggagaagctggtgcccttaaacctgcacctaataattgaaaagtgaaactcccagaaacacctcctgcaataacagctaaaaacattaatggcttcatcatcacatatgggaaatagatttcatgaataccacctataaagtggataatgattgctcctggagcagatgattttgccgcgcctttgccaaagaaagtgaatgctaataaaacacctaatccaggccctgggtttgcctctaataaatatagaattgatttaccaaactcgcttacttgttccgtacctaatggagtcagaattccgtgattgatggcattattcaaaaataggattttggcaggttcaataaaaatatttgctaatggaatcagatgtgcattgacaatcactgcaacgcctgctgccattacttctgtcaatgtgtttacaacaggtccaatgacaacaaagcctaacagagccaaagcaaaacctagaagacccgcagaaaaattattgactagcatctcaaagcctgcccgcactttatcttgaaaaaattcatcgaacttcttaatcgtatatccgcctaatggccccataatcattgcacctaaaagcattgggatgtctgttcccacaatgacccccattgtagcgattgccccaacaactgcgccccgatctccagcaattactttcccgcccgtgtatccaatcagtatcggtattagataagtcagcatcggaccgaccattgaagcaaaggattcatttggcagatagccatctggaataaagagagccgttaacacgccccatgcaatcaatgcgccaatattgggcattaccatactcgacaatgtactacctagtttttggaccctcgactttaaagacgcattcctgtctgcttgtacttgttccatcttcattctcctcccaacttgtttttacaccttgattgtaggcgctttccgaaagcttcgaaagtcgtactttgtcacaggaaactgtgccaaaatttgtctcttatctacaaaaaaaagccatgcataatgcatgactaatcaataaatgcccttttctactcttctagcgatagtattttttggatttcctctattgtagcggcgtcgcttaatagttttacattttggatatctgaacaaaaaaaagcaatttcttgcaagcatgacaactgcttttctttgagaacaaccacaaacagaatcgtagtaacctttgattcttttgcatcgccaaaatcgacaccgtctggtacttgaacaagacaaatcccttcttcattaatccatttgtctgcctcttcttctccgtgaggcaaggctacaaagtttcctatataaacaccatattttttgtgtcgctgaattaaactgtttatatactgaggttgaaccattttttggtctactaagaatgtacctatctcatgcaatgcttcttctgcactttggaatcgctgatctaacaaaatatgtgttgctggaatatccactattttctcctccccattattgtttgatttcttcaatcaaaagcgtagcaagcaattgataaatgatggaaaaatttcctgaattaaatatttctgtattgagatcattcataatgatggaaccgctaatcctccctaagattttactgctttgctcatcgattggataaggagcgagcataactaacaagcgagttacgttaatctcttgtttatccatcgcataaagtgatagtccttgtgataaatcaaagattttgaaaactggttgcaaaatttctgtacttgacgcatgaaaaagggcaaagtgagtcttcggtattccaacaggggcttgtaaatagcgcttcactaatttattggctactttttttctgtcttgcactaacgctttggaaaaatgtttcatcacttcagataatgtttcttctaagttggggccattgtcaatcgtttgaagagtaaacaattctaataagcggttaatctcctcaataaatgctagaacatcttcataggtatcttccctagtagaaactggcgtaggtattgcatgagaaagtctctttttctgactaagcagacgaaattcttcttttagttcctgaatgtcttcttccaataaaataggagatactagcttatattttcctcgataacctggcaacaaagatgtggaaatcaccaagtcgtagttgccctcaattttatcctgttcgatatcccccacacggaaaaaagtaattttattgataaatggaaattgctttcttagctgcatctctaacaaactaattgaagccagtccgcttggtgatacacctgcaatattgacttccatcactttaggattcttttctaatgagtttgcgaagtgcaataccatataggcaatttcttctgttgaaaactgctgttgtgggaaaacaagcggtaagcttaaacggattgcttctgcaatttcctcatattgtttcattattttttctaaaattggattgtttagatggttctcttccaaaatcgctcgggtcattaccccagaaatatgtgttagcaacattttatataaaatttcatcttcaaaaaaatcaacctcagtgtgctggctaatcagttcgatcaaccgttttacctgatatgccaaagttgtatcaaaattctcttcaaaaaaatcgcggtcaaaagaattagaaaaatcccctaataaaatcgcaaaaaaaactatttcattaaccgaatacaaccgcttcgtttgttcagcaacttgagcaaaaatctgtttagctacctttagcaaatctttgttgatttgacttggataactttcttcctctactgagaatcctgttgctactcgctccatggctaaagcaagcataataccaataaaagccaacttgcgatcacttaactcaggatatttagattcaaccacttctcttataagatcttgcgctaaaatcaagtactgtttttcaataaactcaaataaaaaatgcgccgtttgttctgcttcaggaaaatgaaaaaactggtattcatttatttccatcatcaacgtattcgctgctactaaacgtcgatgtttttctggtcctttgagctcatatccttgattacggacaattgtcaacggaaggcgcgccaaactttcttctaattgtttaatatcagaaaaaaaagtagtattactgatttgatagagctctaaaaaacgatggctactaatcggcttagcagtagttgctaattgcagcaaaatcctatgttgtcgctctattgacgcaaactcttgggatggatcagacataattgcttcttgcagctgagtgatactattcccgacaatgactcgaaaatgtccacgaccttctttttctaaggatgcccctacagtacgcaacgaattctctaaattggctaattcgcggtagacagtccgcttacttactttcaaaagctgcatcattcggtccatagaaacaggaccgttactgttcattagctcagtcaacaaaatagtttcacgcttagtcaagaacataggcgactccttctgtcatcaattgacgatatttggaagttgtcactaaatcatcgacaactaagtgggtgacatttgttaatgcagccatttgctgaaaatctttttgaacgatatataatgcctctggattaaactgggttgtctcaatatcttctttctttacctcaataggtatggctaattcattggcaattttacgaacgattgcaacagccatcgtttgagcgcctcttttcttgccttcatacaaaaaaatcaatgttgggattttttccccaactttaaaagaaacatttgctaccgtttcttgctcttgctttaaaagtttaactagtgttttatactctgattccgctaaaaagttactcaagaagtaatgttgtgcttgaggtgtctttgtttgagctaaagcaccaagccctgattgggtaataactaaaagatcttctccatccttcaactgataaattgaattataatcgacaggtatggaaatggctgcttcttctaaatgtttagttaataaacttgccccaattgcgctagatcccatccccgcgtcgcatgcaacgataattctctttactttatccatacatattgttccttccgtacttttttcattcactgagtgataggtcaaaacaaaataggcaacaaaaaaagaaacaagcgtgcttaccaatactccagctaatacgcctgaccacatgtgatttggcgtatttgttaagatagccaaaatagaacctggtgaagccggtgatcgtaagccaactttactcaattgaaaaataaatgtaccagtagctccacctaaaatcggtgcgataatcaataatgggttcattaaaataaatgggaaataaacttcatgaatacctcctattgcttgcacaaatgcagcagcagtcgccccatttcttgcttttttagaaccatacctcatacatgcaaacaagacgcctaaaccaggaccaggattggcttcaagcagaaataaaatcgacgttccatgaatactggcgccttcaacacccaacggcgtaaatagaccatgattgataatattattaaaaaaaagaacctttagtggctccagaaaaagatgaatagcaggaaataaattctgcttgagaaaaaaatcaactaaatgataactttgttgactaagctgatcgagcaaagggccaaatacaaaaaagttacataaaaatagaagacctccaattaagcctgcagaaaaattacgaaagagcatctcatagccagtctttacttttcgagaaaagatatgatcaaagaatcgaagcataccacccgttagcggaccgataatcattgctccaaaaacttgtggaaattgagaggttaaaatcatccctaaaattgcaattgctcctgaaactccacctcttattggttcaaccatttttccgccagtgtaagcaagcaatattggtaagagaaaatgtaaaatagcttcttctgacttgatcaaccccccctgatccgcatgtagtacgggtacggcaaacgcaatgactgcccatgcaataaaaatacttacatttggcatcatcatatcagaaaaataatgagtatagagttttaaaaattgaattgtttgtcctctgtcttttattcccttcatcctcctcacctacctaacactagtataatttggttttctctaaaaaggaataaccatagattatgcttcctccttttgaatgtaccaaaaaagctgacgaaaaacgtcagctcaagttattgccttatttttaccattttttatttaattaacacgcacagcaaaacttggtgcgtaataagagtagctgctaactgaaacgctttgtccaatggtaggtgcatgaatgtattgtcccccaccaagtgcaatagccacgtggtgcgtacttccgcgcgatccccaaaataataggtcaccagcttttgcttcattgattgagataaccgtgccagaatactcttgatcataggtcacacgaggtaatgaaattcctacttttgcaaacacatattgagtaaaaccagaacaatcgaatccgttcggtgtcgttccgccccagacatatggtgtaccaagatatttcattgcttctgaaacaattgctgacccgtttacagattgtgaaggaacgtttgtattgttttctggtttattttcaggcttatttacaattgtttcttgttttggtgtatcattttctactgagtcacttgttccggtactgttagtactggaagattcatttgttgagcttgattcatttgagcttgactcatacgacgaagttgattcgcctgtttttgttgtactacttgtgcttgattcggcttgcgcagcttcttcacgttctcgagctgcttttgccgcttcttttgcggcagcaattcgtgcctgttcagcctgatagctttccttttgtttttctaggtcggctttttcatcttctttagatgattgttgcaaagcaagatctgcttgcaaaacattcaagtctgcttgcttcgattgaagtgctcctacttgtttctcaagttcaagttgatttgcttcaatttcttttagttttttatcattttcattttttttcgttttaaccgtttcttgatccgctttttgttgttgaaccaattcgttattagcactaacaatcgtcgtcatagcttgaacgcgaccgatagcatccgttaaagaatctgcttcaagaacggcatcgataaaattggtgctttgtccattcacttggacatctcttgcttgttcttgaatcgctttttcccgtttttcaatacgaacattcaagtcgtcgatttctttttgtaatttttctgaatcagcatgtaaagtagattgttgcgtcaataatgcttcagctttttcattgatagctgcaacatcattttccaatgctttgatttgtgcttgagcatcagcttgttgattttttaggttactgatttcttgatctttttgttcgattttgctatcaaagtcgtctgccgcgacaagtgttggtgctacaactgaagtaagcgcaatggaactcactaatattactgatagaatacgttttttcacccttcattcctccgcctgacttttcattgaaagtttaagttaattttaaaatatataagaatatctaaagtctttttacgataaagcgattgtaacatagatacatgtcaagcagataaaaagaatgttacaaacagatttcaaataatctaccagattcgatacaaaacataacaaaaaaatgaagctattcttctttgaatagcttcatgaatggaataactaaaataacaaataaaataatatttaatagcagtgtcggtgctaagaaacgagagacaaaaaatgaagtattgactgttgctattttaaataacaactgtatccccaaagttaccatttcaagacccgtaacgaaaataatcattccaaaaaacatggtgaatatgttttggtatagcgttttatttaaaatatacatgatccacacaatcatcgggaatgcgacagcataaataccaattatgccaatatagtaaagatcatacaagcatccaatgatcaatgcggttataatcaagtagtttttaggcaaatatctggcactacataggaaggcaatcaatagtaaatgtgcactcgctatataattatcttgcgtccagcgctcaagtaaacgggttaattgtccatctaacaacatcatcaagaaaaaaaatgctccggcaaagtactttaaatacgtattttttttcatgcctatttgtcacccgccaaacgtttgataatagtaactgcttgaatatcatacatttgtgcataaggttttacatatacttttgtatctaatccaaattcatctttggtggtactaacaactgtcccaacagcaaggtcggctggagaattccctcctaatcccgaggtttgtacaacatcgccttctttcaattgtgtacttccagtcaattgactgataaccaaggacttctctttttgatcataactacttagaattccaaaagtttcgccgtctttcccgctgattcgaacaggaaaatgatttgaattttgattttcagaagtcaacaattcgatttttgaagatgctgcattcacttcaatcacacgcccaatcaaacctttttgggacataaccgccatatttacttcgacaccatctttcgtgccacgatccacaacaagcatgtcttgccatgtatctggtgaacgattaataacattggcagtaattttttcatagttagtcaatgtttcgtttaactcaagctcttctttcaatgattcgatttctcgcttgtaattttcatttgatcgagcaatctcatcataactatcgattttctcttttaaacgttcgttttcttcatacgtgacaaaaagtttctttacagagtttgcaccggtttcgatccaccgtactggagctgtaatcaccttgtccacgataccaatcgtgtcgttgactgccgattgcacaaaactggatgaattcccaactgctcttctagcaatcgtcacactcaacacagaaacaactaaaatcacaataattaacgtgattatgatatttttattaggattaaactttttcacaaagacacctcaatgagttccaaactgatagccttaattttaccactaaaacgatgtaaacaaaagttaagttgtacgtcttaatgctttttttgtaattagctttctgaaattttcaaaaataaaaaaagagacttgactgtctcttaatctttgctttgaataacagcaataattcccgtttcaaatataaaggatgcttcatccgttatgaattcattactagcaaatgatgtaggatgttcaaccttcacattttccaataggtatttgctttccattaatgaaagattgtcaatgggagtcagacaacaatatgccagatatttcatgcccttttctttacgtatggaatacttacctggcaaaaagaaccgaatgacattttgcttatctaatagactaatattatgagcgaaaggctgaaaccgtttctccagtacaatccataaatttgctaaaaaatgatcgattcttccaccagttgcaccgataatatcaatctttgcattgggaaaatgctcaatagccatcaataatgcgagttgcgtatccgtatcgtctttttctgccggagcttgaaaaaaattttttgcattctgtcgcactcgttctctttcttcagaagaaagagagtcaaaatcaccaatcgcaaaatctaaaggcaaatcctcctcaagcagataaaatgatccccgatcaataccaatgtatttatcatacttctttagagacggccaagtttgctttttgccacctgcaactagaagaatattcatttattacaacacttctttcaatgctttgatttgatcagcaggactgtccgcgtcatagatgtagctaccagcaacaaacacattggcaccagcttctaaacagatccgagctgtttttggaacgattccaccatctacttcgatatcatagtgatacccatttttctctttcaattgtgctagttccttgattttagcaactgtttcttcgataaaagattgtccaccgaatccagggttcacagtcattaccaatacttgatcacacatggatagtacatgttgaatagcggctactggcgtaccagggttgataacaatttccgcctttacattttcatttaaaatcatttgaattgcgcgatgaatgtggggagtagcttcggcatgaactccaattatatcggcaccagcttcggcaaacgcatgaatataattttctggctgagtaatcatcaaatgaacatccagtggcaacttagttatcggacgaatagctttgacaacatttggtcctaaagtaatattaggaacaaattggccatccattacatctatatggatgtaatccgcgccgtttttttctacaagttcaatgtcccgttgcagattcgcaaaatccgcacttaaaattgatggtgctagtttaatcatattcgtttccctcacttatttttctttttataaattggacgacgattttcaatctcctctaaaaattgaacatagtttttataccgggtaagtgcaactgtttgctgttcaactgcttcttttacagcacaatttggctcatttaaatgcatacactcacgaaaacgacattggtgtgccaatgctaaaaattctggaaactgtttgggcaattgtccactatcgatttccaaaaaatcgattgagctgaatccaggggtatcagccactaacccatcatataatgtcaataattctacatgtcgcgttgtatgtttccctcgacctaatgactcagaaatttcggccgtttccaaatctagctctgggactattcggttaagcaatgtggattttcctgcgccagattgtcccataaaaactgtcagtcgttccgggaaaattctttgtaactccagaagatcgctattatctgcttttgaaacaatgacttggtaaccaatttgttggtacaaagcggcaattttttgaacctcactttgatcactcactaagtctgttttactcaaaaagataattggttcaatctctttatactccagtgtaactaaaaaccgatctaatagattaaatgagaaattaggctggatcaaacttgtcaccactacaccttgatccacattggccactggtggacgtatcaattcattttttctcggcagtatctctaacaagtatccatcagttggattactactttcaaaaataacttcatccccaacaagcggcgtgatttttctgtttctgaagtttcctcttgctcgagtttgaaagatagtatcttcagactctacataatagaatccactaagagctttgattatttgtcctttcaaaaattctcctcctcatttctttttattgtaacatatttataactcatgaataaatttctcaccaataaaaaaagcctgaagaagactcttcagacaaaaaaatcgggaagacaggattcgaacctgcgaccccttggtcccaaaccaagtgctctaccaagctgagctacttcccgataatagatattaaaaaaataaaaagactacgcgcccaagaggagtcgaacccctaaccttttgatccgtagtcaaacactctatccaattgagctatgggcgcatattaagaaatgccgaggaccggaatcgaaccggtacggtgatcactcaccgcaggattttaagtcctgtgcgtctgccagttccgccaccccggctgattgcgatggcaaaagcggaaaacggggttcgaacccgcgacccccaccttggcaaggtggtgctctaccactgagctatttccgcgtattcctgatgccggctaaaggacttgaaccctcgaccctctgattacaaatcagatgctctaccaactgagctaagccggcaatgaagtgcgggtgaagggacttgaacccccacgcccgaaggcgctagatcctaaatctagtgcgtctgccaattccgccacacccgcataggttattactatgagccgtacagggctcgaacctgtgaccctctgattaaaagtcagatgctctaccaactgagctaacggctcatatgggggttaacgggttcgaaccgctgaccctctgcttgtaaggcagatgctctcccagctgagctaaacccccataatttaaaaaaaacgcgtggcgacgtcctactctcacaaagggaaacccttcactacaatcggcgctaagaagcttaacttctgtgttcggcatggttacaggtgtatccttctcgctatcgccaccacactattcaattgagtaagtattgctcactcaaaactggatcgaagaatcaaaactcttccgagtttccttgcttttttcaatcgtggttaagtcctcgatcgattagtatcagtccgctccaaccatcactggccttccacttctgacctatctacctgatcatctctcagggatcttactttcttaaagaaatgggaaatctcatcttgaggtgggcttcacacttagatgctttcagcgtttatcccttccctacatagctacccagcgatgcctctggcgagacaactggtacaccagcggtaagtccatcccggtcctctcgtactaaggacagctcctctcaaatttccaacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtggactcttgggggagataagcctgttatccccagggtagcttttatccgttgagcgatggcccttccatgcggaaccaccggatcactaagcccgactttcgtccctgctcgagttgtagctctcgcagtcaagctcccttctgcctttacactcttcgaatgatttccaaccattctgagggaacctttgggcgcctccgttaccttttaggaggcgaccgccccagtcaaactgcccatctgacactgtctcccagcccgataagggctgcgggttagagtggccataacgcaagggtagtatcccaccattgcctccatcgaaactggcgtcccgatctctacggctcctacctatcctgtacatgcggtacagacactcaatatcaaactacagtaaagctccatggggtctttccgtcctgtcgcgggtaacctgcatcttcacaggtactaaaatttcaccgagtctctcgttgagacagtgcccaaatcgttacgcctttcgtgcgggtcggaacttacccgacaaggaatttcgctaccttaggaccgttatagttacggccgccgtttactggggcttcaattcgtaccttcgcttacgctaagcactcctcttaaccttccagcaccgggcaggcgtcagcccctatacgtcatctttcgattttgcagagacctgtgtttttgataaacagtcgcttgggcctattcactgcggctgctcgttagagcagcaccccttctcccgaagttacggggtcattttgccgagttccttaacgagagttctctcgctcaccttaggatgctctcctcgactacctgtgtcggtttgcggtacgggccattgttttctcactagaagcttttcttggcagtgtgacatcagaagcttcggtactattatttccctcctcatcacagcttgtccttgaaagtagaagcatttgactcccactaagactcactgcttgaacagacatatccatcagtctgcacttcttagcctcctgcgtccctccattgctcaaacaaaaacaacgggtacaggaatatcaacctgttgtccatcgcctacgcctgtcggcctcggcttaggtcccgactaaccctgggcggacgagccttccccaggaaaccttagtcatacggtggacaggattctcacctgtctttcgctactcataccggcattctcacttctaagcgctccagtagtcctcacgatctaccttcaacgcccttagaacgctctcctaccaatgcaccttatggtgcactccacagcttcggtaaactatttagccccggtacattttcggcgcagggtcactcgactagtgagctattacgcactctttaaatggtggctgcttctaagccaacatcctagttgtctgtgcaaccccacatccttttccacttaatagttatttggggaccttagctggtggtctgggctgtttccctttcgactatggatcttatcactcacagtctgactcccggatatgaatgaatggcattcggagtttatctgaattcggtaacccgagatgggcccctagtccaaacagtgctctacctccatcattctcaattccgaggctagccctaaagctatttcggagagaaccagctatctccaagttcgtttggaatttctccgctacccacacctcatccccgcacttttcaacgtacgtgggttcggtcctccagtgcgttttaccgcaccttcaacctggacatgggtagatcacatggtttcgggtctacgacaacatactcattcgccctattcagactcgctttcgctgcggctccgtctcttcaacttaacctcgcatgctatcgtaactcgccggttcattctacaaaaggcacgctatcacccattaacgggctctaacttgttgtaggcacacggtttcaggatctatttcactccccttccggggtgcttttcacctttccctcacggtactggttcactatcggtcactagggagtatttagccttgggagatggtcctcccggattccgacggaattcctcgtgttccgccgtactcaggatcctcctaggtgtgagccagatttcatctacggggtttttaccctctttgacatacttttccaagtatttcgactatctgtttcaactaccatatcggagtcctacaaccccaacaagcaagcttgttggtttgggcttttcccgtttcgctcgccgctactcagggaatcgaattttctttctcttcctgcaggtacttagatgtttcagttctctgcgtctacctcacagctgctatgtattcacaactgtgtaacatcctataaaagatgctgggttcccccattcggaaatctctggatcatagcttacttacagctccccaaagcatatcggtgttagtcccgtccttcatcggctcctagtgccaaggcatccaccgtgcgcccttattcacttaacctttgaccttacggtcggtgagtacttcttctagcgatagaaggttgctcaagaaaataagcgttgaacttattaaaaaactctttaacttgtccactcggtgtgtgttacttgttttgattttcttcgatatccagttttcaatgaacaaactattttgagagtaaacctctcaaaactgaacaaaggcaaacgatgtgtagtcttccgtactattccttagaaaggaggtgatccagccgcaccttccgatacggctaccttgttacgacttcaccccaatcatctatcccaccttaggcggctggctccaaaaaggttacctcaccgacttcgggtgttacaaactctcgtggtgtgacgggcggtgtgtacaaggcccgggaacgtattcaccgcggcgtgctgatccgcgattactagcgattccggcttcatgtaggcgagttgcagcctacaatccgaactgagagaagctttaagagattagcttagcctcgcgacttcgcaactcgttgtacttcccattgtagcacgtgtgtagcccaggtcataaggggcatgatgatttgacgtcatccccaccttcctccggtttgtcaccggcagtctcgctagagtgcccaactaaatgatggcaactaacaataagggttgcgctcgttgcgggacttaacccaacatctcacgacacgagctgacgacaaccatgcaccacctgtcactttgcccccgaaggggaagctctatctctagagtggtcaaaggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgtttgctgcagcactgaagggcggaaaccctccaacacttagcactcatcgtttacggcgtggactaccagggtatctaatcctgttcgctccccacgctttcgagcctcagcgtcagttacagaccagagagccgccttcgccactggtgttcctccatatatctacgcatttcaccgctacacatggaattccactctcctcttctgcactcaagtctcccagtttccaatgaccctccccggttgagccgggggctttcacatcagacttaagaaaccgcctgcgctcgctttacgcccaataaatccggacaacgcttgccacctacgtattaccgcggctgctggcacgtagttagccgtggctttctggttagataccgtcaagggatgaacgttctactctcatccttgttcttctctaacaacagagttttacgatccgaaaaccttcttcactcacgcggcgttgctcggtcagactttcgtccattgccgaagattccctactgctgcctcccgtaggagtctgggccgtgtctcagtcccagtgtggccgatcaccctctcaggtcggctatgcatcgtggccttggtgagccgttacctcaccaactagctaatgcaccgcgggtccatccatcagtgacgcaaaagcgcctttcaactttcttccatgcggaaaatagtgttatacggtattagcacctgtttccaagtgttatccccttctgatgggcaggttacccacgtgttactcacccgttcgccactctttttctttcggtggagcaagctccggtgaaagaaaaagcgttcgacttgcatgtattaggcacgccgccagcgttcgtcctgagccaggatcaaactctcataatgatttgtttgaacgatccataggatcgttaagctcaaataaaattaactttgctagctattgcttgcatgtattttgcttcatataatgaagcgccctacacattggttcgtttgcttgctttgttcagttttcaaaggtctactgcgctgcgttagcaacttttaaatcatatcagattaacaagcgaatgtcaactctttttttaaaagtttttttcgaaagtgtttattcaacaacttcctgtgcgtcatcagcgactccattagaataacaaatgaattgttatttgtcaacaacttttttcaatcttttttgttgctgtatcagcatcaaattgatttcttaaatttgcgacttcgttataatatcatctgttggttctggcgtcaacaacttttttcattttcttttagaaatgatttttgtcatttggcacatgtaataatatagcaactatcttgccattcgtcaacagtaaaatcattgatatttcaacgtttctaaatactgcggttccatcatatattttagttaattctatggaataatctctccatttggaaactatgatgattatttgaattctcaatgttcggtttttattcttgttgtaagtattatttcctatcattcttataaatttaagtatgattttatcaatttcctagaatatttgctaaaataggagaaaagaatattgttcctaggaggatttatatgaaaatacttgttgctgatgatgataaagagattgttgaactattaagtatctatcttcataatgaaggttatgaagccgtcaaagcttatgatggtaaagaagctttaacaaaaattagaactactccagatattgaattactgatattggatatcatgatgcctgaaatggatggcatgcaggttgtaaaagagttgcgaaaagaatcacaaattccaatcatcatgctaactgctaagactactgatatggataaaatacgaggtctagttgctggtgcagacgactatgtaacaaaaccattcaatcctttggaagtgatggctcgcgtcaagtctctgctccgtcgaacaaaaatgcaagctccctctaatcagccagatatcttagaagttagctcattgatcattaatcgtgattctcatgaagtaaaaacaatcaccggaaatgagatccaattgaccgctcttgaatttggtattctctacctattagcatcccatccgaatcgtgtatttagtgctgatgaaatttttgagcgtgtgtggaagcaagagagtgtcgtgtcagccaaaaccgtaatggtccatgtgagtcatctgcgtgataagatagaagaagcaactgatggcgagaaagtcattcaaacagtgtggggagttggctataaaatagatgcgaagtaatccaatagaaaaaaagaaacgtatcaccctcacttctaaagaaatcagtgaattatttgcagaaggaatcgttactgtaatccttttacttctattaaatgtcgcgattttagtcatcttgacttctataagagagaattcaccgttgttagtggaggcgatctatgagtcaaaaaacgcttttacttctgcttttgacacggatatttttcaaagtggccgcaatttcattatccctttgttctttttattagatgtgattgttttatattggcgtttgattcgtcgataccgtcaaatgcagctacggcatattattagtgagcttcattatattgcagagggaaactatgatcatcgtattccatttgaactgcgtggtgacctcaatcggattgtttcaaatattaacggcttggtagatagtaccgtcgccgccattgaagatgaacgaaggatcgaacagtcgaaggatgaattaattacaaatgttagtcacgatatccgaacccctttaacttctattattggttatctaggcctgattgaagatcgtcagtatcattctgaagaagagttattgaaatatactcataccgcttatgtcaaagcaaagcaaatgaaatctttagtagacgatcttttcgaatacacaaaagtaagacagcctagcgtcccaataaatgtcatttcttttgatatggcgcaattagtcgaacaactagctgcagattttgaattagaagcatctcgtaaaggaataaagattgagactcacactcgcccagagcacattattatggacggtgatactgagaagcttgtacgagttttcaataatttattgtctaatgctttaaagtatggaaaaggcgctgacaaaatcgtaatggaagtggaaaaagtaggaacagaagccattctaacagttaagaacaatggacaaatgattcccaaacattcattagactccttatttgaccgcttctatcgagtggaggaatcacgttcgcaggaaactggaggaactggacttggtcttgccattgctcaaagcatcgttgccttgcatggtggctacatttttgcaaaatctactccggattggacctcctttattatccatctcccattaaagagaaatgatttatcaaatacccaaaactatggttgacgaactaacgctttttcgctattctagagaaaatacttactaataaagcatagaacctagtacattttttactttttcagagaactgatggttggtgagaatcagtaatggaaagaatggaatccagttcattaaaagtgtatcttttgaaagaaagatcgtgtgcccacgttacgggcaacaagggcagcgttatgctgaactcgggtggtaccgcgaaagatcttttcgtcccaagaatagggatgaaaaggtctttttttatatgaaaaacaagggggaagaattatgttagatattaaaatgattcggcaaaattttgacaaagtccaaacaaaattacagactcgcggagtaaaaaaagaagtattagaagaattcttaaagttagatgaaaggagacgacaactcctagtagagacagaagaattaaaaaaagttcgaaatgaagtttctgcagaaatagctcaactaaaacgagcaaaaaaagcagcagatgataaaattactgagatgaaagaagtcggtactaaaatcaagtctcttgatgacgagattgcaaaaattgattcagaaatcaaattgatcgcaacgacattacctaatctgcctcatgactctgtcccagttggaaaagatgaagatgacaatgttgaagtaagacgctgggctacaccaaaagaatttgatttcgaagcaaagcctcattgggatattgccgaaaacctaggaatattagattttgaacgaggtgcaaaggtagccggtagccggtttgtctactataaaggattaggtgcccgtcttgaacgagctttatataactttatgctagaccaacatgtttatgaacatgggtacactgagatgattactccatatattgttaatagcgatgcaatgtttggaactggacagtttcctaaattcaaagaagatgttttccaattagcggaaacagatcttaccttgattcctactgctgaggttcctttaacgaattattataatggagaaatattggatcttgaccaactaccggtttacttcacagcattaagtccttctttccgctcagaagctggaagtgctggtcgtgatactcgcggattaattcgattacatcaattcaacaaagttgaaatggtcaaactaagtgaagcagcacactcttatgaagaattagaaaaaatgactgcaaatgcagaagacattttacaaaaattacaacttccttatcgagtaatggcattgtctacaggtgacatgggcttctctgctgctaaaacgtatgatttggaagtatggattccagcacaagaaacatatcgagaaatcagttcatgttctaattgtgaagattttcaagcacgtcgagcaatgatccgttatagagataacgatggcaagattcattacatgcatacattaaatggttcaggactagcagtcggtagaactgttgctgccgtattagaaaactatcaaaatgaagatggtagtgtgactataccagaagtactagttccttatatgggtggagttacccgaattgaaaaaaattgaagaacaaggtaggatgagaattcctaccttttttctttaaatattctaagaaatacccccctattgttgaaactatattacagttatgttacgtttattttactttatgatgataaatggagggataaagtcatatgtctgacaaaaatacctatgcacgtcgtagccaacgtcacaaacaagaacctgatacctgtgaaaatacaaatcaattgaatgaagctgtaaagcccaaaaccggaaacgaaaacaaacaacaaaaaataccgaagaaaaaatctaattatagcaagtatatattcgcattgtttaccgcacttattctagtaattgtcgctactggcggctatattgtttatacattaaaacagcaagaagcagaagctcaagccaaatatgaaactgctgcaaaaaatctcatggcttcaatccaagaagagcaagaccaaagtggaatttcaacgaaaatagatactataaatgacggagaaaataagtgccttgtttaccgtccagttgatgaaaatactgttcctttcaaaaatgcaaaccagctcttagacgagcttgctcaaaagcaacaaaaaaagcatcgtgaaaaagaagtgcttacagttgccagaataaaagcaacagcaatatcttctaaaattggtcagtatagaattgaagcagatagttttatctgggatcgcagtaaggaaaattttaaaaagccagacagtatttctgagaaagccatttatgtttccgaaaaaactggcaaagaaatcacaaataaggatttgattccagatgaaggaagtctcttaggtattcaacaggtgattcagcaatccatacttgatcaagccaaagaacctgaaaaaatcattgatgctgtattaacaatggatagaatttcttatgatagtaaaatgacttatacacctgatgaattgactatcgtcttaccaaaaaattcaactggaacttctaaagtcactctaaaatacaaagatattgctccattcattgatacagatctggtttcgcaagaaagtataaaagatacattacctgcattagatgaaaataaaaagtacgtcgctcttacttttgatgatggtccaaataatagctcaacacttgatttgttgaatatactaaaaacagataacgtgaaagctacttttttcatgttaggacagatggtggatcaaaatccagatgttgcaaaacaagtccacgacgagggtcatgaggtagcaagtcactcgtattctcatccacaattgaatacactttcgacagatgaattacaaagggaaataaataaaaccaacaaagctattttcaaggctacaggcgtcttgcctcgcaatatccgtcccccttatggcgctattgataaaaaaagtgctgaaacaattggcatgccaattattcaatgggatattgactcacaggattggaaatcaaaaaatcctggaacaatcaataatgttgttaaacagaatgtctttaatggcgcaatcatcttaatccacgatatccatcctgaatcagtcaaagctgtaccaggattgatctctatgttaaaacatgaaggatacgaatttgtgacgatcgatcaactattgtcaggaaaacaaaaaccattgcatcaatattttggtatgaatgatgaacgactagtagaataaaagaaaagcgaacgtattggcgttcgcttttcttttattcataaacatttgtagtaaatatttgaataagtaaatgagaaactgctttaggctgcatctcagaaaaatcttttagccagcgttcaatcaacccgatcgagccacagacaaaataactcaaacataactctaattcttctcttgttgcgtcttcgaaataaatagtaaagcgtttaaacgtttccggtctgattttttccaataacaaatctaataaatgactgttattaagcagaatcaaatgacttacactaggattttcttgcagtataagtaataatttttctagccatagatctaatgggagattttcttgttgcaaattatctgcaatttgttcaacgatttctttctcaatctcctctaaaaggtctgcagtatctttgtaatacttataaaaagttcctcgattgatatcagcacgctgggcaatctctgtaattgtgattttttcaaattcttttcccatcaaaatctcttgaaatgcttttcgaatcactttttttgtatattgtgttcggcgatttccaactattcctaccataacttcaatcctttctatacaaaaataacttaaatgtttatttaataacagatgaataagatttgaggattgcccctttttttctttcttagtatactaacgctatgtgattaaatcaacaggtgttcaaaatatggaggcgttatatgagttatgtagaagtaaaaaatacgtataaaagatataaaatgggcgaaaccacgattaccgctaatgaagacctatccttttcaattgaagaaggagaactagtcgttattttaggtccaagcggagctggaaaatcgactattctaaatatattaggtgggatggattcacctgatgaaggtcaaatcattatcgataatattgatattgcacaattttcggataaacaacttacagaatatcggcgcaaagatgtaggcttcgtttttcaattttataatttagtcccaaatctaacagcaaaagaaaatatcgagttagcaacagagatatcaccgaacgcacttgacccagatgctgtgcttaagcaagtaggattagaaaataggtccaataactttccttctcaattatcaggtggcgaacagcaacgagtgtccattgcccgagcgctagcaaaaaatccgaaattacttctttgtgacgaaccaacaggagcattagattttgaaaccggtaaacaagtattgaagctgttgcaaagcgcaagtcgtcaagctggaaatactgttttaatcattacgcacaacagtgccattgctcccattgctgatcgcgtgattcgtattaatgatgctacagtgcgctctgtagaaattaatgaatcccctatttcaatcgatgagatcgtttggtaggaggaaacaaatgaaaaataagacgtatttaaaagcaagcttacgagaaatcaaacagtctaaaggaagatttatcgctattgttttaatcatctttctaggtacttttttgtatgtaggtgtcaaagcaactgggcctattttgaatcattctgcaagtacttatgttgatgaacataacttagctgatatacaggttacatcaacactaggtatcaccgatcaagatcttaaagtagctaaagagtcagggattcaagtggaatcaggctaccaattttattatgtagcagaagcagatgaagttgtccaaatcaattcttacaacaaaagccaaaaacaaaacgcattaatccttgaagaaggccatttaccaaagaatagcaatgaaattgtcttagatacacaagcgaaagaatatggctatcagttaaacgatacttatactatcgactcgcaggatactataaaggataaaaacttcaaaatcgttggttttgccaactcgcccctatttatcagtaaagctgaacgaggctatgcgaatgttggcagtggtacagtaacatattttgcttaccttcccgaaaatcaatttctgagtgatgtccaatcggtgctctatctgtcttttgataatgtgaaagatttagaaacttactctgattcctatcaagaaaaaatggaaaagaatcaagaaaaagtagaaacgctttttgctgatcgtccacaagaacgtgtagcagaaatcaaacatgacgcaatggaagaattgaaacctgctaaggaaaaaattgaaactggaaaagcacagctattagatgcacaaacagaattagatgctgctaaagctcagattgaacaacaaaaaagtgcaacccttctgttaccgtctcaacaacaagctggtgctattgaacaactgaaaactgctgaatcgacattgattaaacaacaaaatcaaatcaatgaagaaaaagagaagttagctgatgcagaatctacattacaaaaaaaagaaaatgaaataaatgaaatggaagagcctacttatttatttaatctaagaaaagataatcctgggtttcaagaatacggcggtttatctgatcgtatagcggcaattgcaaatgtctttccagtattcttcttttttgtagcagctttaataacttttaccaccatgactagaatggtagaagaaaatcgaaaagaaattggcacattaaaggctttgggatatgcaaaaagagagatagctcgaaaatatatcatctatgctcttttatcatctagtataggaattctcttaggagctgtactaggtatcgaatttctacctcgattaatctattttctttctagtgaacggtatcttttaggtggtgtccgggtttactatgtttgggggccaatcattcaagctacagtcgcctttattcttgctactttaggtgcagcccttgttgtcctctatcgtgatttgcgagaaaaaccagcgcaactattgcaggcacgtgcaccaaagccagggaaaagaatttttctagaatacattcaaccactttggtcacgcttgagctttaatcaaaaaatcagttaccgaaacatttttcgctataaatcacgaatgattatggcaataattgggatcgcaggatgtgcaggacttatggtcgctggagtgggtctaaaagattcattaagtgctgtttcgcaaaaacaatttggtcctatcactgattatcaagcaatcgtcacattaaaagatagtaaaacaaacaataccgaagtttttgaaatattagaagaagatccaacaattcaacaatccctgcttgtattgaatgaaacaattgagttacggtccaaagaacaaggaaagcaaagtctgtctttagtggtaccttctgatactgactcattctcgaactatatgcatctacactctaccgatggaaaaaaaatgtcactagatgatggggccatcctaacgatgaaatatgcggagctttttgatatccacattggagatgagctaaccttttatgataaggatcaaacagctgtaacagtgaagatagctggtatcgctgaaaattatttaggtaactcactttatctttctagaaatgactatgaaaaagcaacaaatacgaactatcagcctacatcgcttcttatcaagagtaaaaagatggaacaaaagcaagaagacgcattagctaaagaactattgaaaacagaccaagttcagaatactaccttcctgtctagtcaaatcaaagcgcaaaatgagtccatggggaatctgaattccattgttcttatcttggtcattttatctggtgccttggcatttgttgttctatacaatttaacaaacattaatgtatcggaaaggattcgggaactctctacaattaaagttttaggtttttacgacaaagaagttacaatgtatattgttcgtgagaatgttgtctttactttgctagggatcctagctggttatggagtcggatacttactgactgattttattctccgacaggcatcgatggaaaacatggtttttccattagtgattagttgggctgcttatgcgttagccggcggcatgaccattttatttacaatcattgttatgttggttactcattataaattgaagcatgttgatatgatcgacgcattgaaatcaaatgaataattttcccatacaaaaaatggcggtcagtgtcttattaagactactggccgccattttttatttaatgttttcacgtgaaacaatttctaagacttcacagaatagtttggtgcttctttagtaatttgcacatcgtgagggtgagattctttcaaaccatttccgctcatttggataaactgtgcttcatctcttagttgttttaagttcgctgctccaacatatcccatccctgattttagaccgccgatcatttggaataaaatatctgcaacactgcctttataagccactcggccttcaattccttctggaacaagtttatttgcttcattaactccaccttggaaataacgatcacttgaacctttttccatagctcctagtgaccccattccccgataggttttgaaacgtcgaccttgataaatttcaaattcccctggagattcatccgttcctgccaacatacttcctagcataactgcatgtccgccagcagccaaagctttgacaatatcaccagaatatttgataccaccatctgcaataatggcttttccatattgtcgagccactgaggcagcatcataaatagccgttaactgagggacacctacaccagcgacaacacgtgtcgtacagatggaaccaggaccaataccaactttaacgacatctacaccagcgtcgtatagagcttttgttccctcagcagttgcgacattccctgcaattaatgttgcttcaggaaaatgtgctctgatttcagaaattttacgcagtacgcctgcactatgtccatgagcagtatcgattacgatcgcatctgctccagcatctaacaatgcttgtgctctttcaaaggtatcactggtcacacctacagctgccgctactaataaacggccatgagtgtctttagccgcgttggggaattcaatgactttttcaatatctttgatcgtaatcaatccacttaaaataccttcatcatcaacgatcggtaatttttcgatcttatgtttttgcaagattttctctgcatctttcaaagaagtaccaaccggtgccgtaactaatttttctttggtcattacatcagaaattgcgattgaataatccgtaacaaaacgcatatctcgattcgtgatgattccaactagtttacgattctccattgtttcaacaatagggacaccgctgattcggtatttactcataaggtgttctgcatctgctactagatgactaggtgttaagaagaacggatcaatgattacgccactttcagaacgttttactttccgcacttcatctgcttgggcagcaatactcatatttttatgaatgacccctaatccaccttgacgagccattgatattgccattttactatcagttactgtatccatactggcactcatgatcggtatatttaacgtaatattttttgcaagctgcacatgcatatccacatcatttggcaacacatgactttctgcaggtatcaataatacatcatcaaacgttaaccctttttttacaaatttggtttcccagttggacatttttgtaaccactccttaaagttaatatgtatttttaaaaaaatagcaaatattttttcataagtcaactattcggaaagctttcttatttattcctgtgtaatctgagaaaacagccagaatcacaaaagatttctattttctccctcttgtatgacacataataaaaaagacccacacgcatgaatgacatgtgggaacttattattatcctctaggaacagataagctactaataatattgtatttcttcttcaagtaatatttagctgctagtgccacagccccaatcacaatttcgattaatgggtcgacctgtggattaagtggtggttgaagcatagcagaaagtgagatagtcacgatccatactaagaaagctccaactaaaatcaaaataattttccacattttcggacgtttacttttatctgcgcctggacgttcatattgatacatgtacttgtacattaagtagaagacccaaccagctaacatggccattaagaagagggtcaacaatccgtaaggctgtgcttgaccttttgtaaatacccccatcacgccgagcattaatccaaaaatacctaaaataagcaacgtattgtctaaccacatcaagaatggacctgattctttttgttcaactggcttcgtgatgattgcttccgtacgttcagagactgtcccaaaaagttgtctagcggttttaccacctttttgttcttgaacaagaatcggtaacatctcatgtaatgcgacagttttttcttcttcagaaagattagctgcctccaaagatttttttaaatcaaaaatatattgttggttacgttttgttagttgtttttctaattcacgattttcggaaacatacgagcgcagagtttctggttccataaatcatttctcccttctgcgtgatttcttcacaaaggacattttaccatatttttttttggaagaaagccttttatacattaaaacggaataacataacatcgccgtcttgaacgacgtattcttttccttctaaacgaacacgcccagcttcttttgctgcatgcatattgccatacttatccaaatcttcaaaggaaacagtttctgcacggataaaccctcgctcgaaatctgtatgaataattcctgcagcttgaggcgctttgattccttttcggaaagtccatgcacgaacctcttgttccccagctgtaaagtaagtggctaatcctaataaatcataggccgcacgaatcagttgatctaaaccagattcttcaatgcctaaagcttccaaaaattctgctttatcttcatcatccaattcagcgatttcttcttctgctcgagcactaatgacgatcacttccgcatgttcactctcggcaaattctttcacacttttaatatagggattctcttctgcatttgccacatcatcttctgcaacgtttgctacatatagaacaggttttgttgtcagcaaaaacaatcctctaacgattttttgttcttcttcagtaaattcaatagaacgtgcggatagaccttcttctaaaacaggtttaattttatctaaaactgctaattcagctacagcatctttatcttttgttttcgcaactttagcaacacgtgcataacgtttattgatagattctaaatcagccaagactaattctaaattaatagtatcgatatccgctagtggatctacccgtccttcaacgtgtgtaatattgtcatcatcaaaacaacggactacatgacaaatagcatctacctgacggatatgacttagaaattgatttcctagtccttctcctttactagctccgcgaacgattcctgcgatatccgtaaattcaaatgttgtcggtacagttttttttggatgtactaattccgtcaaacgttgtaaacgccaatcagggacttccaccatccctacatttggatcgatcgtagcaaaaggatagtttgctgcttccgctccagctttcgttatagcattaaataaagtagatttacctacattaggtagtccaacgattccagcagttaaagccatttattatttcactctttctcttttttttctaggatttttttcatttttttgtcgaactcacggcgagtaagcataacaatatggccacagttcgtacattttattttgatgtccgcacccatacggataatttcccaacggtttgctttacatgcatggggtttcttcatttcaacaatgtcaccaagatcatacatatttatcacctcaagcttcatcaaattgaatgttcaataaatcaaggattcgtgttaaatctttctgtgaaaggtactcaatctctattttccccttaccttccttttcatggatttcaacatttgtcccaaacttgtccattagtcgttcttcactttcccgcaaataatagggtttttcacgaatcaaacgaggaattttcttcttctcatttttagcatcattcatttcagacactaattgttctaattggcgaacagtaagattttctttcacacatcgattggctaattttaaaatcagatctttgttttttaaccctagcagtgtgcgcgcctgtcccattgataagcgttcatcttgtaccatctcttttaccaactttggcaatgataatagacgaagataatttgcaatataaggacgacttttgcctaatcgtgttgccacttctgcttgtgttaatttaagatttttcatcagcatttcatacgcttcagcttcttctaaaggatttaaatcttctctttgcagattctctagaacagctacttgcatcattgcttcttcatcaaaatcacggataattgcaggtatcgtttctttttttgctaacttggatgcacgaaaacgtcgttcaccagcaatgatttcatagccctttacagtagattttctaacaataatcggctgaaaaacacctgcgtgttgaattgaattagctagttcttgaagtgagacttcatcgaaggttttacgtggctggtaagggtttggtcttaattcatttaaagggagctcaaccacttcctctgttttgatatctacttcttctaagccttgaagatcttgaaatagtgcatcgatcccccgtcctaaacctttccctttatttttcacgagtcaacacttcctttgctaatgtctgatatacttcagcaccctttgaacgtggatcataatcaataatagatagaccatgacttggggcttctgataagcgtacattacgtggaataattgtctcataaactttttcttggaaataacgacgaacttcttctactacttcagcacctagatttgtccgtgcatcgtacattgtcaacaaaacaccttcaatttctaattcaggattaaagtgcttttgaactagacgcacggtattcaataactgacttagtccttccaatgcgtaatattcacattgaacgggtattaaaatagagtcgctggctgtaaatgcgttgatcgtcaaatgtccaagagagggggggcaatcaataaatatatagtcatattgatctttgatttcattcaatgccgatttcaaacgagattcccgagccatcattgaagttaattcaatttcagcaccagctaattgaatcgtcgcaggaacaatatctaaattctcacgactacttggcaatattgcctctacgattggtgtttcattcaccaatacatcgtagatatctttatcaacatctggtttacgaattcctactccacttgtggcgtttccttgagcatcaatatctactagtaagactttttttcctacataagccaaacaagcacccaggttgactgtagttgttgttttgcctacgccgcctttttgatttgccaccgaaataatacgtgccattctgcttcctcctacttgattggttgtttcgccggcaaaccaggtttgcgcgggtatttttttggcgtttctttcgtttttttgatgatcaaaagatgccgttcatcattactaacaggcaatgtcaattttttttcttcaataaacttaccaccaagtaatgcgattgctgattttgcttctattaattcttcttcgctttttgctgcttttaaggcaaagaaatacccgttctttttaacgagaggcaagcatagttccgttaaaatatttaaacgagctactgctcgagcagtgacataatcaaaggattctcggaactctttttgaccaaatgtttctgctcgatcgtgaaacaagtaaacatcttttaaacctaaatctgccactaaagtttgtagaaaagtaatccgtttattcagtgaatcaacgattgttatctttagttgtgggaagatgattttcaatggaatactaggaaaacctgctccagaaccgacatcacataaatgtgcatcttctttgaatgctgtcacaaaagctaaagaaatcgaatcataaaagtgtttcaaatatacttctttttgatcggtaattgcagtgaggttcattttttgattccattcaatcaaccgatcatagtaagtagcaaattgcttgagctgttcagatgacaactcaattccttgaatagataattgtttttgaaattcttctggcagcataatgaatcctttctatttttgtgaaacagaaaaatgtttcacagactaattcctactttaacgcaaaaagttttgagatgcaataggaatacattgctttcaaagagattttaatttttcctcgacggtttttatttaattgtttgtggttagtttatggcaaaaatttgaacttgtactcagacaaaaaaatgcatcattttccatgaccggtaaatactaactcactagacttaaaaaatacaattacaaaattgtatctgtattctgatgaaattgttacttgtatgaatagtcagtaagcagctgtaaaagtgtattatcagttctatcaattttttagttaaataatatagaaagaatctgtttttcaaaaaaattgatcgataaaataagagctacccttcaacatgaaggatagctcttattttttctattattaattaatgaacgcgaggttcattattttcttgcatacgatcagatgttcgttctactgcacctttagctttttctgtttgtcgagaagcaaaatctcctgtttttgatgccgcgttggagactttatcttgaactgtctcgctatcttcttgatactcagcttctgacttaatgtcgaccacattgatattgacttcaattacatctagttgagtcatattggctacttctctatgaatcacttctttaactctctccgcaacttctggaatatttcgtccgtactctaccacaatatccatatcaacagcgacttgttttttgccaacttcagtattgatcccagaggttacattatctgtatttactaatttctctgcaatatttgagaaaaaccctccatcaactgttaacagaccatcaacatcttccagagcgataccaataattttttgaataactttatcatcataggtcaaagaaccatttacggatgtttctccagtaggaccttgaaatccactaggtttttctgtctgattatgatgttggtttccaactgttgcttggtgctgttcaaccgcttcttgcgcatgaggtacaactgggtctggtgcttctgtcatcggaatatcgttttcttttgtcgtatgatccgtgtttggtacgactggatctggatgtgcacttactggtttttcattttttaattcgtttttttcgttattcatttaaattcctcctgagttcttattgttttagaaattgatctaacattcccgttctctgtacgtacatccctagggcaaagcctaatcctgtgagcataatgatcagtagtgttttgaaaaagccaatgctgacaaatagtaaagctaacactaatccaatcgctccaaagataatagggatcttatattgttcaagctctttcattgatagacctcctattctacacgtggattttctgtagtgttctgttcttcgtagttcgtataagaaacatcgactttgactttttcacttgatcctaacgttctctgcaaatcttgctggatctcagtcatcaaattctctgttttacctaccaatgcagaagtacgttttaatcttcctttgatttttacgctgattcgatttttagttgctttaacattcactttaggtccatcaacaaattctttttcactaacctttgttcgtactaaaccttcaattgcttttttatcaatcgacaatgttcctttatcctctttcaaaacaaaagtagcttttgttctaggatagaagataataactagaatgacacaaaggaaaaagataattagaactgctgctgcccaaaaaagatattgttgtaggaaataattcgtgaaaaagaaggaaataaatctttcttttcgatctaagccaaacggtaaactaaaataaggattgcccaataataatattggcaataacacagtaataaaaatcaatgaaactacaatcgctaaagttttccatcctttattcataagacacctcctaatatttgatcacttcttatagattgattgcttctccaccagttactccataaatttgagctgttacatagcttgctttgttcgacgccagaaaaacatacacaggtgctaactcggctggttgtcctgcacgttgtaacaacgaattttggccaaattcaggtaactgatcctgaggttgtccatgatccaactgtagaggtgtccaaattgggcctggtgctacaccgtttactctaattcccttttcagcaaactgttttgccaaactaactgtgaaactagcaatagcagccttagttgcagcataatccattaaatgagcacttggactaaaagcttgaacagaagtcgttgtcacaatggccccacctgctgggagatgaggttctgcagctttaactaaagcaaacatggataatatattcaccatgaacgtatcttttacttgctcaaagggtaattctgaaatagagggacgtgtgatttgttgcgcagcgttcaaaacaagcgtatccaaaccgcctagcccttttactgctttttcaacgatttcttgaggagctgcttcatctctcagatcatatggtaataggatagctttacgtccagcatgttcgatatagtgagcaacttcctcggcatctttttcttctcctggaaaaaaatgtaaggcgatatcggccccttctcgtgcaaaagcaatggctgccgctcgaccaattcctgaatctccacccgtaatcagtacccgtcgattttctaattgatttgttccttcatatgtttcttctccacaatccggctcaggcatcatttcttcttgcaaagcaggagtatcttgatcctgttttttaaatttacctgtttgataaagttcgcgcggatcattcaaaataggttcactcatcttacatcctccttttgtctataacaaaattctaaaccattaaatttttttttggaaatataacgcttatttaattttaaaatcaaaaataatttcaataaaaaatgagcaaagaaagcgtacacaaagagggttttaataaggatatagaaggtaaaataatttatttctctttccgtactgaaattcaattttttccatattttggcaaaagtaggtaaactaaaagaaaaaagggggagtacaaaatgccttggaatatgaaagattatcctgcttcaatgaaaaacttggatccgttggttcgaaaaaaagcaattgatattgcaaatgctttgttgaatgatggctatacagacgatcgggcaattcctattgctactagccaagcggaaaaatggctagaaaatgccagtgaagaagaaaagaaagaatttcgtaaggaaaaaaatcctcaaaaagatgatccgcataccaaaaataaaaatgcaaaaaaacttctgacagccaatgttcaagtaaaatttgaagaagataaatggattgttttatctgaaggcgctaaacgagctagtgatcattttaatattaaagaagatgccattgctcgggcaaaagaaatcgctgaaaataaaaaaactggtgtagaagtatttaaaaaagacggtagtcaccaaaaagattacgacttttccgaataaaaaaaccagcctctttaggctggttctgttattttcgcaatctttccttgttcgatgtagaccatcaatatacttatgtcggctggatttacgccactaattcggctggcctgagcgatggtttctggttgtattttttgtagtttttgttttgcttcagttgcaagaccattgattgcttcataatcaatgttttcaggaatccgttttgcttccatgcgttttagtttttctactttttcaagggcttttttgatatatccttcatatttgatctgaatctctacttgctcaatttccttcggctttaatgcagggtttgcttcgataaactgcaagagttcttgataatttacttctggacggcgtagaaattcatttgctagaacaccatcttttaatggagcggttcctttctctttgaggaaagtttgaacagatggtgttggtttgatacgtactttttttagacgttggatttcctcttctacagctgttttttttgttagataggcttggtattgtggctcttccactaagccaatttggtgtccgacttctgttagacgaagatccgcattatcgtgacgcagcaacaaccgatattctgctctcgatgtcaatagacggtatggctcattagtcccttttgttactagatcatcgatcattactccgatgtatccatcactacgtttcataataaaaggctcttttccttgaatcttaagagcagcatttatgccagcaatcaatccttgacccgctgcttcttcatatccgctcgttccatttgtttgtcctgctgtaaaaaggttagcgatgacttttgtttctaacgttggtcgtaactgatgtggtactacaacatcatattcaatagcataacccgtacgcatcatctcaactttttcaagcccggcaatcgaatggagcatattgacttggacgtcttctggaagagaagttgaaagtccttggacatacacttcttcggtatctaaaccttctggctctaaaaataattggtggcgtgatttatcggcaaaacgtacgattttgtcctcgatcgaagggcagtaccttgctccaaccccttcaacgattccagtaaacattggtgcacgatgaatattatcattaatgatttgatgtgtatgttcattggtataggttaaccagcaaggttcttgattggttttgtattggctatctggtgtactgtaactaaagtgattaggggcttcgtcaccgggttggatctcagttacatcatagttgatggtacttgacttcacacgtggcggcgtaccagttttgaagcgcgcaatttctaaacctaactcttttaaatgatcagcaagtccaatggatggttgagaattattaggtcccgaagaatattttagttcaccaataataatttccccacgtagcgcagttccagcagtaatgatcaccgattttgcttggtaacgagctccagttgcagtaacaacgcctttacaaataccatcctcaacaatcaatttctctacaataccctggcgtaatgtcaaattttgctccatttcaatggtttttttcatttcagaagcataggcatgtttatctgcttgtgcacgcaatgcacgcacagccggtcctttacctgtattcaacattctcatttgaatgtatgttttgtcgatgttcttccccatctcgcccccgagagcatcaatctctctaacaactacacctttagcaggacctcctactgatggattacaaggcataaatgcaaccatatctaaattgatggttaacaataatgttttacaccccatacggctagctgcaagagcagcctctgatccagcatgacctgcaccaactactatgacttcatattcttctgcttgatattcttgcatcgtattctcctttggtaattttattttcctaaacaaaattgactaaataactgcgtaattaattcatcttgaacactatctccaacaatttcgcctaaataatcccagcaacgagtcatgtcgatttgcacaagatcaacaggcatcccactttcaattccttgaatcacttctgctaatgaatgttctgctttttccaataatgcaatatgacgagtgtttgagagataagaagcatctttgtctcctgtatttccaccaaaaaacaagtcagctattgcttgttcaagttgatccaatccttcactcgttaataccgaaataggaagagcaggctcattctctaaatagggcactaaatcttcttgattgattcttgaaggtaaatctgttttatttagcaaaatgattcgtttatttccagatgtaatatccaataattgtttatcttctgtcgtgagtgactcactttgatttagtactaataaaatcaaatccgcttcactgagtgctttgcgactacgttcaacaccaattttctcaacgatatcttctgtttcacgaattcctgcggtatcaactaactttaaaggcacaccacgtacgtttacatactcttcaataacatctctagtagtacctgcaatatctgttacaattgctttctcttcccgtaataagtgatttagcagacttgacttgcctacgtttggccgaccaataattgctgtactgagaccttctcgtaaaatttttccttgctgtgctgtctgtaaaagagcttgtatctgtttctggacttgatttgccttttctaataataaacgtgttgtcaattcttcgacatcatcatattctggataatcgatatttacttctacctgtgccaatgtctctaagatctcttgccgtagttgtcggatcaatcttgagaggttaccatctaattggttgatagcgagattcattgctttatcagtttttgcacgaatcaaatccatcactgcttcagcttgagataaatcaacacgcccattaagaaaagcacgctttgtaaactctcccggttcagccaaccgtgctccttgacgcaaaactaattgcaaaatttgattaacgacaacaatcccgccgtgacaattgatttctactatatcttctctagtaaaagtttttggttttctcatgatcgataccataacttcatccatcatttgatacttctcagggtcaaaaatatggccataatgtatcgtgtggctactcacatctattagttttttctttcctgattgaaagacagcatctgctatggaaattgcttgttcaccacttaatcgaacaatactgatcgctccttcaccagggggcgtagatattgctgcaatcgtatcaaattcctgcgtaatactcaccatactaaagctcctcctaatttttcgcataaaaaaagcgcccactccacccgtcaaactcataacggatagacttagcactttgactgcttgtcatataaaattctgggaatagattagcatactttttattttgtcgcaagtctacttggtaaacttttaatcttttgcatcaaacactaaaaacatttaaaataaaggaaacaataagaaatgagggatttttatggatacgtccaaaaaaatagatacttcttctcgcatcaaggaaatcattctttctaccggaaatgtcaatcggccatacattgttcgcgatattgtctttgccgcagataaaattgaagtagatttatttgatcctgaaatcgatttgaatgcgcttctctctgatgttgcttttcgtctgaaagaaaaagcgcacagttatggtgctaatgctgtaatcaactgccattttgaacatgatcggatcgtagaaaacgggaaaacttttttagaaatttttgcttatggaacagttgtacagtttacacaatctacaatcggcggctaatttccctcaacaataaactgctaaacctcgatactaccaatacaattaatataaaaaaagagtccgtggcaaacggactctttttttcaccaaagtaagaactactcatcgtatgtttactttgataagaatgatttctagtcaagaatacttggtttcaaatatcttgtcaattcctttagacttaaaagttttttttcgctggttcaaccaccaagtaccgataaggctcgtcaccttcagagtgtgtttgtatttgggcatccttacttaatgcagaatggatttgctttctttcaaaagctggcataggttctaaaaagactggtctacctgtgcgtttaactttttctgctgttctattggccagacgctctaaaattgcctgacgcttttcacgataatcacctacattaacaaccacggatagcttatttgctgcgattcgatgaatatatacttgtgccagatattgtaaagcatttagtgtttttccatgttttccaatcaggagtccttgcttttgtgtatctagatgaaaaacgatcaagccatcttctcgtgctgtttttacaagggctggtgcattcaatgctttagaaatgttagtcaaatataaagcaagatgagtaagtgcttcatcatcagaaagatcctttgcgttaggtttttcttccgtatctgcttgcgattttgcagtaagcactgattcctcaagttcaggttctaagatttcttcaattatttcagttactgattctgtgatgatttttgattcatccgcagcacttctttcaattgatacgcgggcattctttttaccaatacccaaaaaaccttttttcccctcatccaaaacatcgatcactgcttgatccttgtttaaacctaaagcatgcaatccttcttggatagcttcatctactgtaagaccttcataaatcggcattatctgcaacctccttttatttcttacgttttttcttaggactcattgctttcttcagcgctctttctcgttctctttcttttcgagcagcttcttctctttcttgacgaatcttgaatggattattcaaaatcaacgtttgtactacttggaatgcattggatacaacccagtataaagataaaccactagcgatattgatccccatcaataaaatcatcaatggcattgcaaaattcattatctttaaactagcatttgattctatttgactcatactagacaaataagtacttgcaaatgtaaatagtgcagctaatataggtaaaataaagtaaggatctcggtcccctaattgtaaccacaaaaattttccttcttgtaaagctggaacccgcgaaatcgattgccataatgccatcaaaattggcatttggacaagtagcggcaaacatccggcataaggattcacattattttctgcataaagccgttgcgtttctgcacgtaatttattttgtgtttcactatctttcgatgcatattgttgttgcagagcttttaattttggctgcaattcttgagtttttcgcatactctttgtttgaaaatgcattaaaggcatgagaataatccgaatgatcagagtaaatagaatgatcccaatcccagcattgccaaaagatagcatcttgatcgcttcagcaaagtaataaacgatataacgatcccataatcctgaactttgcgcattcacttccccagttgcgctacaggcagacaagacaactaccaatgagacgatccccaaaaatagtaagatacgttttccttttttcacttaaataattcctttccgttagttaatgattttagcaagctttaacacatgctctaaattcgagtatacttcttgagaagagcaattcgaaacacttggacgagcaattacgatgaaatcgagtgtaggtttgattctaggttgcatatccgtgagacttgctctgatttttcgtttgatctcatttcgtttaacagcatttcctactttttttcctacagataatccgacacgaaaatgtggctgatctttctgcagaacatagacaacaaatttacggtttgcaaaagactttcctttctgaaaaaccttttgaaagtcttgttctgtttttacgcgatatgcctttctcatcttggttccttcatttctttctactttggttactcacctgtcaataataccatatttagtaaaagggattcactatattccttaaaaaacggcataaaaaaaaccactggcattcagtggcttatgcagaaataacctttctgcctttacgacgacgacttgctaaaacacgacgtccattttttgtactcatacgtttacggaatccgtgaactttttgacgtttacgtttatttggttgataagttcttttcatttagtgacacctccatcaaaataatgattatgcgcatagacatactttgatagtataacgagtcagacagtgttttgtcaatataaaattcacccactttactgtcttgttttccacataaactaaatgaactgtgtgttacttgtggattttgcatttttgtggataacttatttccacaagtttttcctgctttttccacaaataaacacccttctaaaaagttatccacatacacttttctagctgtgcataaatcagtaaaatgcttttacatcaacgtatttgattaacagttacttgtggataaacaagagattattgtaacaatccacaaacactcctcctctgtggataaccgtaaatttgataagttaatttctcctgttcttttttccatagatgtggaaaagtatttttttctaaccttttttattataatctgtggaaaacttcttccatccgtgctaaattagtattatctattcttagctataggaggacaatttatgtcatctgctgattccatttggcgagatcttcagaaatcttttaaagaagaacttaatccagcaagttacagtgcttggatcgaaacagccaacatattatcttttgaaaaaaatcagttattgattgaagtacccagtgatcttcataaatcttattgggaaaaaaatctagctgcaaaaattgttgagatgggcttcatgaagaccggtgaagaactaattcctagttttgtcactgctgaagaagcagaagctctgcaaaaatcgccttctgttgaacaaacagttactgaaaaagcagaaaaaaaaggaaaaactattctaaacgaaaaatatacttttgatacatttgttataggtaaaggaaatcagatggctcatgctgcagctttagttgtagctgaagatcccggttctatctataatccgttattcttctatggtggtgtgggtctaggaaaaactcacttgatgcatgctatcggacatcaaatgctgttaaaaagaccaaatgcaaaaatcaaatatgtgagcagtgagaacttcactaatgattttattacttcgatccaaaagaataaaatggaagattttcggaatgaataccgaaatgttgatctcttacttgttgatgatattcagtttttggtcaataaagaagggacacaagaagaattctttaatacatttgaagagctttatcgaaataacaagcagatcgttttgacaagtgatcgcttaccaaatgaaatacccacgttacctgaacgattggtttcacgtttcgcatgggggttatctgtagatattacacctccagatctagaaactagaacagcgattttaagaaaaaaagcagaagctgaacgcctcgaaatccctgacgatacactgagttatatcgcaggacaaattgattcgaatattcgggaattagaaggcgcattagtgcgtgtacaagcatttgcaactatgcaaaattcggatattacaacaagcttagctgcagaagcaatcaaagcattaaagtcaagtcatggaagcactcaagtttctatattgcaaatccaagaggaagttgcaaaatactaccatatccatataaatgatctcaaaggaaaaaaacgtgtcaaaggaattgtcgtacctcggcaaatcgccatgtttctttctcgtgaactaacggataactctttacctaaaattggagctgaattcggaggtaaagatcatactacagtcattcatgctcatgaaaaaatccaacatctttcagaaacggatcctaccattaagaatgaaatttcagaaatcaaaaacattctctttagttgagttgtggataaagcaaaaacatgtcaaaaagttatgcacaggttatacacaggcgttttcgttgacgtctcaatgatattttctagttatccacaatactaacaagcctattactactattaccttatttaataactataaataaaaggagtgctcctaatgaaagtaactttaaatcgaacagagttcatgcaagaattacaaaccgttcaacgtgccatttcatcaaaaactaccataccgatccttacaggtgttaaattagttctaactgataaaggtttaactctgacaggaagtaatgctgatatttcaattgagacttttttaagcgtagagaaagaaaaagttcaaatgaaaattgaacaaacaggagcaattattttacaagcacgattttttagtgaaatcattcgtcgcttaccggataatactgttacgctggaagtgatagaaaataaccaagtagcaataacttcagggaaagctaactttactgtaaatggattagatgctgatagttatccacatttaccagttgtcgaaagtcaagatcgcatcgaagttcctgctcacattctaaataaaattgttaacgaaacagtttttgctgtttcacagcacgaaagtcgtccaattctaaccggtgttcattttgttcttgaaaataagaaattattagctgtagctacagattcccatcgattaagtcaacgagtaattccattagaaagtggggaagcgaatttcaacatcgttattcctgggaaaagtttgactgaattgtcccgttctttaacagatgaagaagaagctattcaaatcagtatcatggataatcaagtattgttccaaaccaatacaatgaagttctattcacgcctattagaagggacttacccagatacaaatcgattgataccatcaagttttaacacagaaattgaattttcagttccagaattgttgtcagccatcgaacgcgcatctttactttcacatgaaggaagaaataacattgttcgtttgtcaataaatgaaaattctgttattttatatgggaattctcctgagattggtaaagtagaagaagatctatcctacgagcaagtttcaggagaaccattggaaatctctttcaatcctgattacatgaaggcggctctaagagcttttggagatacaaacatcacgattcgctttatttctgctatcagaccattcactttggaaccaactgaaagtcaaggaagctttattcaattgattacaccagtccgcacaaattagaatttttcatatttattgtaaatgcatgaaacaaacgtctgaaaatacaaaaatagtttagaagggcttaaaatcgattttaagcccttctttttgtttttgcttattttttatctaaaacaatcaaaacttctcagaatgaaaattatacggataaatttgttttattccttaaaaaagagtataataatggtatacgttcttctatagaatcgagggataatatgaaaatgcaaatacctttagaaactgaatatatgacgttaggacaaatgttgaaagaagtcagcgtaatcagcagtggaggacaagcaaaatggttcctagctgaacatacggtacttgtagacggagagccagagaatagacgaggccgcaaattatatgcgggaatgaggattgagatacctgatgagggtactttttttatggtaaagaaggaagcctcagatgcgtctgaataatcttcagctaaataattatcgcaactatgaatctttggaattatctttcgataaaaatcttgtcatttttttaggcgagaatgctcaaggaaaaaccaacgttttagaaagtatttatgttttagcgatgacaaaaagtcatcgaactacaagtgaacaagagttgattcgttgggatacagctggggctcaagttagcggagctgtgtctcgagggcattctaccataccattagaattatttttaactaaaaaaggtcgtaaaacgaaagtcaatcatattgagcaaaaaaaacttagtagttacatagggcaattgaatgtaattctttttgcccccgaagatctttcacttgttaaaggaagtcctcaagtaagaagaaaatttatcgatatggaaattggacagattgatccgatttatttgtatgatcttgtgcaatatcaaagtgttttgaaacagcgaaatcagtatttgaagcaattatttgaaaaaaagcaaaatgatgagctctatctcactgtgttgactgaacaattgattgaatttggcagcaagatcatttttgcacgacaacgttttgtaaaacgattagcattttgggccaatcaactccatcaaaaaataagtgatgaaaaagaagttttacaaatagaatacttgtctagtgttggtactgtaagtgcatctctagaacaagttcaacaacaattcaaagatgcactggatcaagtgaaaacacgtgaaaaaatgagacagatttctctagtgggtccacaccgagatgatctcaactttttaatcaatgataggaatgttcaaacattcggatcccaaggtcaacagcgaaccactgcattaagtgtaaaattggcagagattgatttgatgaaagaagaaacgggagaatatccgattcttttgttagatgatgtcatgagtgaattagacgattctcgtcagttacacttactagaaacaattgaaggaaaagtacaaacatttattaccacaaccacacttgaacatgtaaaagataaaatgtctgttgaagcagagattttttacgtagacaaaggacacataaaaggagaatagactgaatgacagaagaagaaaaaagtttagttgaacgtgccaaagaatatgacgccagtcagattcaagtcttagaaggtttagaagcggtacgcaagcgtccaggaatgtatatcggatcgaccagttcagaagggctccatcaccttgtgtgggaaatcgtagataattcgattgatgaagcacttgctggttttgctacagcaattcaagtaattatcgaagaagataatagtattactgttgtcgatgacggtcggggaattcctgtagatattcaagcaaagactggcagacctgctgttgaaactgtatttactattcttcatgcaggtggaaaatttggcggtggcggatataaagtttcagggggtttgcatggtgtaggttcttcagtggtaaacgcattatctaccacattagatgttaaagtatacaaagaaggcaaagtttattatcaagaataccatcggggagctgttgtcgaagatctaaaagtgattgacgaaacagatcgtcatgggactactgttcactttgtaccggatcctgaaatatttacagaaactactgtttttaactttgataagttggctacacgtgttcgagaattagcttttctgaatcgcggcttaaaaatttcaattgaagataaacgagaagaacatcctgttctgaaggaatatcattatgacggcggaattaaaagctacgttgaacacttaaatgcaagtaagacagttatttttcctgaaccaatctatcttgaaggggaacaacagggcatcacggttgaagtttctctacaatacacagatagctatcataacaatttgctaagttttgctaataatattcatacgtatgaaggtggtacccatgagtctggattcaagacagctttgactcgggttatcaatgactatgcacgtaagtctaagctaatgaaagaaaatgatgagaatctaacaggtgaagatgttcgagaaggtcttacagcggttatttccatcaaacatccagatcctcagtttgaaggacaaacaaaaacaaaattagggaactcagaagtgcggactgtaactgatcgtttattttcagagcatttcacaaaatttttgatggagaatccagcagttgggcgccaagtagttgaaaaaggactgctagcctctaaagcacgtcaagcagctaagcgtgcgcgtgagatgactcgacgtaaaggtgctcttgaaattagtaatctgccaggtaagctagcagattgttcaagtaatgatcctgagaaatgcgaattatttattgtcgaaggagactcagctggaggatcagctaaacaaggacgaagtcgtgaattccaagcgattctgcctattcgagggaaaattttaaatgtcgaaaaagcaagcatggataaaattttggcaaatgaagaaatccgttcactatttacagcgatgggcacaggatttggagcagactttgatgtttctaaggcacgttatcataaattagtaattatgactgatgccgacgtcgatggcgcacatatccgaacattgctattaactttattctatcgctatatgcgaccaattgttgaagctgggtatgtttatattgctcaaccaccactttatggggtaaaacaaggaaaaaatatccattatatccaaccaggcaaaaacgcagaacaagatttgaagaatacaatcgagtcattgcctgcaacgcctaaaccaagtgttcaacgatacaaaggtttaggtgagatggatgaccatcagctttgggaaacaacaatggatccggaaaaccggatgatgctccgtgtaagtgtagacgatgcaattgaagcagatcaaatttttgaaatgctaatgggcgatcgtgtagaaccaaggcgtgcctttattgaagagaatgcacattatgttaaaaatcttgatatctagccaatcgtaaaggaggaaatagcttgagtgaagcaaaacaaaatattcatgatgtcaatctgacaagtgaaatgcgtgagtcctttatcgattatgcgatgagtgttattgttgcaagggccttgccagatgttcgagatggactaaaaccagttcatcgtagaattttatatggaatgaatgaattaggggttacaccagacaaacctcataaaaaatcagcccgtatcgtcggtgatgtaatgggtaaatatcaccctcatggtgatagtgcgatttacgaatcaatggtgcggatggcgcaaccgtttagttatcgttatatgttagtggatggtcatggtaactttggttcagtcgatggtgatggtgctgccgcgatgcggtatactgaagcccgcatgagcaaattagcaatggaaatgctaagagacattaataaagataccgtcgattttcaaagtaattacgacgatactgaaagagaacctgcagtattgcctgctcgttttcctaatctcttagtcaatggtacaacaggtattgcggtaggtatggcaacgaacattccaccacataatttgaatgaagtaattgcggctattgagctgctaatggaaaatcctgaagtaacaacgaatgaattgatggaagttttgcccggacctgattttccaacgggcggcctagttatgggtaaatcaggtattcgacgggcctatgagacaggtaaagggtccattacggtacgaggaaaagttgaagttactgagatgcctaatggtaaagaaagaattctagtcaccgaattgccgtacatggtcaataaagcaaaattaattgagcggatttcagaacttcatcgagacaaacgaatcgaaggtattacggacttgcgcgatgaatcttctcgagaaggtatgcgtattgtgatcgatgttcgtcgtgacgttagtgcttcagttattttgaacaacctttataaaatgacggctcttcaatcatcttttggctttaatatgctggcgattgaaaaaggcgtaccaaaaattttaagtttgaaacgaattttagaaaattatatcgagcatcaacaagaggtagtaacgcgtcgtactcaatttgacaaaaacaaagcagaagcacgtgctcacatcttggaaggattacggattgctcttgatcatattgatgaaatcattgcattgattagagcatctaattcagatgatgaagcaaaaaacacaatgatggaacgtttcagtctatcagatcgacaagcgcaagcgattctagatatgcgtttgcgtcgtttaacaggattagaaagagacaagattgaaaatgaatatcaaagtttgttggaattgattgctgacttaaaagatattttagctaatcctcagcgagttttagaaattatccaaacagaattgcaagaattaggtcaacgctttggtgatgagcgccgaacagaattacttgttggagaagtattgagtcttgaagatgaagatttgattgaagaagaagaaattgtcattacgctgacaaataatgggtatatcaaacgagtagcaaattctgaatttcgggctcaacgtcgtggaggtcgtggtgttcaaggcatggggattcacgatgaagactttgttaaaacgttgatttcttgttcaactcatgatactttacttttctttactaacatggggaaagtttataaagctaaaggatacgaaattcctgaatacggacgagctgctaaaggtattcctgtgatcaatcttttaggtattgattcaaacgaacgcatcgaagcgattatctctgcttctggaggacctcaagaaggacgttatctgttcttcacgacacggctaggtatagtaaaacgtacatcagttactgctttctccaatattcgggccaatggattgattgctattgggttacgcgaaaatgatgaattagttaatgtagtagaaaccaatgggcaagatgtgatgattattggtacacacaatggctattcagttacatttaaagaagagctggttcgagatatgggacgaactgctgcaggcgttcgaggcatccgtttaagagaagatgactatgttgtcggcgcttctgtgatcaaagaagatagtgaagtattagttatcacagagaatggctacggaaaacgtacaaaaggttcagaatacccaataaaagggcgtggtggtaaaggaataaaaactgcgaatattactgcgaaaaatggaccgttagctggattgactacagtttcaggcaaagaagatatcatgctaattacagacaaaggtgtcattatccgatttaacgctgaaacagtatctcaaactggacgtgcaactttaggcgttcgcttaatgaagatggaaaacggagcgaaagtagtcacgatggccactgtagatccggaagtttctgaaacagaagaagaaatatcttctgaaagtcagaatgatgaatagtaatgtaactccaacacgatgttgttggagtttttttaataaatgaaaatattttgtgcgtacttattgatgcaagcaattttactgtcaaaagtcaaaaaattaatcttgtattatggatgaaaaaaatgtataattggtatttgtgagtagtctaatcaggcgactctctctgctcctagaatatactaggggcctaagaccacagggaggtgaataatcaatggaaaatacgaagtatgagatcttatacatcattcgtccaaacattgatgaagaagcaaaatctgcattgatcgcacgttttgacacgatcttgacagataacggagctgaagttatcgagtctaaagattggcaaaaacgccgtctagcgtatgaaatggatggattccgtgagggtatctatcacatcgttaaagtttcttctccatcaaatgcaagtgcaatcaatgaatttgaccgtcttgctaaaatcaatgacgatattatccgtcacatgattgtcaaagaagaagaataaaattgtttcacatgaaacaaagcgatgaggagatgatgaactttgattaataatgttgtattagtaggaagattaaccaaagatcctgatttacgatacactgctaacggcactggcgtcgcgtcttttacattggctgtaaatcgtaattttacaaaccaaagtggagaacgtgaagctgatttcatcaattgtgtgatttggagaaaacctgcagaaacactggctaattatgctcgtaagggtacattacttggtgtgactggaagaatccaaacacgttcttatgacaatcaacaaggacaacgtgtatatgtaactgaagttgtagcagacaattttcaattgttagaatctcgaaatgcttctgaacaacgacgcactaccgaaagcggtggaaatacttcgtataatactagtggttcttctggattcggaaacaatagcacaaatcaaaatcaatcctctcaaccatcaggaatgcctaactttgatcgagataattctgatccattcggaaactcgtcaattgacatttcagacgatgatttaccattctaataaattgataggagggaaatagaatggcacaacaaagaagaggcggacgtaaacgtcgcaaagtagactatattgctgcaaatcatatcgaacacatcgattataaagatacagaattgttaaaacgtttcatttctgaacgtggaaaaattttgccacgtcgtgtaacaggtacaggggctaaaaaccaacgtaaactaactgttgcaattaaacgcgcacgtatcatgggattacttccatttgtaggcgaagaataatttttactattcaaaagttgacaactgtttttgacagttgtcaactttttttgtatatactattactaaaaacatttagtgtatttgttatttaattcaatctttaaataacgaaaaaatctttgccggtatttgatttgtggtttcctaaataaagtttcacgtgaaactttatttaggaaatcgcttattcgtataagatgtggtaaaatataaaagtgtttaatatttctatagcagtttattgaggagttaaattatgtcagcaatcggacttatttcaattgataactatgatgatctaattgacaaaaaagatgacaaacaaatatcctacttgaactctttgatcacgacgctgatttcagattgggccagtgaaaatcatatcttttataagcggattaattctgaacgctttctttttgttgccaagattgaagatattgagaagatgaaaaaagggaattttgaatttttgacacgtgttcgtaatattgctgaaaagaatgacttagccttaaccattagtatgggaatctcttacggagaagaatcgctagagacaataggcgaagtagctcaaaataatttagatatcgccttggtacgtggtggggatcaagtggtactgaagaaagctgatgaggaagcaaaaccacagttttttggggggaatacagatggtacgcccaagagaactcgtgttcgctctcgggctatgagtactacattaaaaaaaatatttgctgataataaaaaggtatttatcatgggacacaggtaccctgatatggatgctttaggtgcagcctttggagttgcttatatggcaatgatgagtgaacgtgaatgttacatcattttaaatcctaaagaaattactgcggatattgaacgggtattagaagaattgaagaaatatcctgatttagaacgaattgttatttcaggtgaggaagctgtaactttatccaatgaggaaagtgtcttagtaatggttgattatcataaaccgtctatgtcaatctcacaaaaagtttatgatgtatttgataaaattgctgtaattgatcatcaccgtcgcggagatgagtttccagataagccgttgttgacttatattgaatcaacagcatcttcggcatcagagttagtcgctgagttgatacaatatcgttctactcgcaaaacacaaattcccaaatttatcactacttctttattggcgggaatttatgtcgatacaaagaatttctctgttcgaacaactggtagaacttttgatatagctggatacctcaaaaatcatggtgcggatacttcacttgttcaatatatgcttagtacggatttagactcctatttaatgattagtgaactagtttctaaaagcaaacattacaaagaagatatcgttatcgcagtagctgatgataaacgagtatatgacagtgtgacagtcgctaaggcagcggatacgcttttatcaatcaatgggattcatgctgcttttgtgatcacaaggcagcctagtaagttgatcggtattagtgctcgaagcactggcaaaatcaacgtgcaagttttaatggaagcacttggtggaggaggccacttcacaaatgcagctactcaaatcaaggataaaagcttggatgaagtcaaaaaaatgttaattcaagaacttaacaagttagaaagagaatgaggagtgaccacagatgaaagttattttcttgcaagatgttaaaggaaaaggaaaaaaaggagatattaaggatgtaccaaatgggtatgcacaaaacttcttaattaaaaacaacttagctaaaccagctaataatgaaagcatggccgaattaaaaggaaaacaaaaagcacaagaaaaacatgaagcggaattactggcggaggctgaagaactaaaaacagtccttgaaaaggaagaaacagttgttagaattaaagcgaaagcaggagaagatggtcgattgtttggttctattccatcaaaacaaattgctgatgctttgaacaaacaatatagtataaaattggacaagcggaaaattgagttagaacaacccattcgggcattaggttatacaaaggtgcccgtcaaattacattctaaagtaactgctacaattaccgtccaaacggtacaagaataaaaagtttcccaacagtaaaatgttgggtttttttaagcggatatttttgtaatcgaggttctcttgtgctttgatttgatatcctgtagaataaatgaacactagattaggagcgaaagtcatgaatgaagtatggcaaaatcaaattccgcctcaagacattgaagctgagcaagcggttttaggagcaatctttttagacgcggattcaattattgatgcgatggaaattattgaaccacaagatttttatcggcgcagccatcagattatctttcaagcgatgattcaactcaatgatcgtaatgaatccatcgacctaatcacattgaaagcagaaatagaaaaaagtaatagtctggaagatatcggcgggcttacttatttaacagaacttagccaagcttctccttcggccgctagtattgcttattatgcaaaaatcgtggacgacaaagcgactttacgcaacttgattcaaaccgctagtcgtatcgtgacaaaggggtttgaacaagatgaagatgttcaatcgattgtcgatcaagcagagaaaagcattttagaggtttcagaaaaaagaaatagcaacggatttcagtctattgctgatgtgttaaatcgaacaattgaaaatattgatcagttagcgcaaaataacgaagaaattaccggattgcctactggctatgcagctttagataaaatgacagctggacttcaaaaagaagagctaattattttagcagcacgtcctgctgttggtaaaacagcttttgcactaaatatagcacaaaatgtaggaacaaaaacagatcgttctgtcgccatcttcagcttagagatgggtgcagaatcattagtcaatcgaatgctatgtgcggaaggatctattgaagccagccatttacggaccggtcaactgtcagaagaagagtggcgcaatttgatcgtggccatgggaagtttgtcgaatgctagtatttatattgatgatacacctggaatcaaaatttccgagattcgagcacgttgtcgtaaattagcacaggaaaaagggaatttgggtttgatattgattgattatttgcaattgattgaaggtacaggaagagaaaaccgtcaacaagaggtctctgagatttctcggcaattgaagaaattagccaaagaattaaaagttccagttattgcgctttctcaattatcacgaggggtggaacaacgccaagataaacgtccagttttaagtgatattcgtgaatcaggatctattgagcaagatgcagacattgttgcatttctctatcgagacgattactatcaacgtgaaggtgacgaagaggatggcggtgaagagccgcaaaacaataatgtcattgaagtgattattgaaaagaacagaagtggagcacggggaacagttgaattattgtttatcaaggaatacaataagttttcctctctatctccaagagttgagtttgcataggataggttgcgactggtactattgccggttgcttttttttattcgtatttagctttgtataaaaaaaataaataaaatatagttcgtttttttctgctttttttcattttaatgaattcaatcattcgattttagattgaatccatgatcgaatactggtacaatacttatggagtgcaatatataaagaaagaggtcattaaatgtcatctgtagtagtagtaggtacccaatggggcgatgaaggaaaagggaagattaccgactttttgagtgaaaatgcggaagtgattgcacgttatcaaggtggagacaatgcaggacatactattaagtttgatggagtgacatataaattacacttgattccatccggtattttttataaagataaaattagcgtgatcggaaatggcgtagttgtgaatccaaaatctcttgttaaggaacttgcctatctaaaagagaataatataataacagataatttgaaaatttctgaccgtgcccatgttattttaccgtatcatatcaaattagatcagttacaagaagatgctaaaggtgacaataaaatcggaacaacgatcaaagggattggtccagcttatatggataaagccgctcgtgtaggtattcgaattgctgatcttcttgataaagaaatttttgaagaaagattacgtatcaatcttgaagaaaaaaatcgtcaatttgttaaaatgtttgatgatgagccgattgcttttgaagatatttttgaagagtattatgaatatggtcaacaaatcaagaaatatgtaacggatacttcagttattctaaacgatgcgctagatcaaggaaaacgcgtactgtttgaaggtgctcaaggagttatgctagatattgatcaaggaacatatccgttcgtaacatcctcaaatccagtagctggtggagtaactattggtagtggagtgggtccttctaaaatcaataaagtagttggtgtttgtaaagcatatacttcaagagttggtgatggcccattcccaacagaactttttgatgaaacaggcaatcaaattcgtgaagttggccgtgaatatggtacgacaactggtcgtccacgtcgtgttggttggtttgactctgttgtcatgcgtcattcaaaacgtgtttctggtatcacgaatctgtctctaaattcaattgatgttttgagcggcttggaaactgtaaaaatttgtactgcttatgaattagatggagaattgatttatcattatcctgcaagtctaaaagaattgaatcgttgtaaaccagtctatgaagagttaccaggctggtcagaagatattactggatgcaaaacattagctgatcttcctgaaaatgcacgtaactatgtacatcgtatctctgaattagttggggttcgtatctcaacattttcagtagggccagatcgtaatcaaacgaatatattagagagtgtttgggcacaaatctaatcagtgggtagaattaattagtagaattgaatagtagaaagaacaaggcagagtattttagaagaaaatcgatgattttcccgtcttcaagtatgatttcttctgccttgttctttttttgctataataaggttatcaaagggggtgtacctatgtatcaaatcattacagattcatgttgtgatctaccagcaaaaagattagctgaattgggtgttcaatatatatctatgacaattgaacttgaaggaaaagaatatatcgatgatatgggtgaacaatttgatgccaagtggtttttagaaaaattaaaagaaaatgcacaaccgacaacttctcaaatcaacgtcggacgttatgttgaattttttcgtccatatgtagaatcgcacacaccgatactttatctaggtttttcgtctggaatgagcggttcttttcaaagcgctgttcaagctgttgctattcttaaagaagaataccctcatgctgaaatcacactcattgatacaaaatctgctagtttgggagagggttttttagtagcggaagcagcaaaaagacaaagtgaaggttggtctcttcatgaggtcagccagtgggtagaagaacataaattatctctagattcttgggtgacagttgatgatcttcgacatcttgaaagaggcggtagaatatctaaaacagcagcggccattggcggcctattaaatgttaaaccaattattactgtagatacagatggaaagttgaaaaatgtcgataaagtgagaggtcgaaataaatcaattcaaaaaattgttgataaaacagtagcgaatctgcgtgaatctcaaatagagacggtttatcttgcaaatgcaggtgatgacgaagcagcagaaaaagtgttaagactcttgaaagagcaatttccagcattaattatttatcattatcctttaggaccaacaattgccagccatacaggatatggttgtttggcacttttttcattcggaaaaacacgtttgatcagtgattgattttctcttaaatataaaagccaaatgcaagagttcttgcatttggctttttcatttggagatcaattatataattcttgaattctttgttgtacatctttgttgtctaagaactcatcataggtagtctctgcacgatcaacaacacctttatttgaaacggcgataattcgatttgcgagcgtttgaataaattgatggtcatgagaggcaaaaagtaaagagccggtaaaagccataaggccatcattcaatgcagtaatcgattctaaatctaagtgatttgttggatcgtctaagacaagaacattagcttttgatagcattagttttgataacatacaacgaactttttcgccacccgatagaacattgactggttttaagacttcatcacctgaaaacagcatccgacctaagaaactacgtaagaatgtattatcatcctcttctttactagcatactgacgcaaccaatcaacaattggtgtatccgtatcaaattcaccagtagtatcttttggcaagtaagcgtgttgtgttgtaacaccccagcgtacactaccagtatctggcacgatctcgcccataataactttgaataatgtagtcgttgtgatgtcgttgttggcaataaaagcaactttgtcatctttattcaaagtgaatgagatattatctaaaatctttttaccgtcaatagtcacactgacattatctacttgcaacaagtcattcccaatttcccgttctggtttaaatcctacaaaaggatagcggcgtgaagaaggttgaatatcatcaagtgtgattttatccaacattttctttcgagaagtggcttgctttgattttgacgcgtttgcactaaagcgggcaataaattcttgcagttctttgatttgttcttcttttttcgcatttgattgtgattgcaattttgctgctaattgacttgattctaaccaaaaatcatagtttccgacatacagtttgatcttcccaaaatctagatctgccatatgggtacatactttatttaagaagtgacggtcatgggaaactacgataacggtattatcaaagttgattaaaaattcttctaaccagttaatagattggatatccaatccattagtcggctcatccaagagcaagacgtctggttttccgaaaagagcttgtgctaacaacactttcacacgttgaccagctgttaattctttcatttggacatggtgtaattcatcagggatattcaacccttgtaagagaactgcggcttcaggttcagcttcccaaccatccagttcagcaaactctccttctagttcagcagcacggataccatcttcgtcactaaagtcttctttcatgtagatcgcatctttttctttcattacgtcgtataatcgtttgtgacccatgataacagtttcaataactgggtattcttcgaagtcaaaatgattttgtttcaaaacagccattcgttcatcgggtcctaatgaaacatttcctgtagatggttggatttctccagataatatttttaagaaagttgatttaccagcaccatttgcaccaatcaaaccatagcaattgccaggcgtaaacttaatattaacatcgtcgaacagtttgcgatctgaaaaatgcaaacttacatcacttactgtaatcaattcttttcctcactttatatatattgacattgagtctcctagcattatagcgatgaatgttgaaagtttcaagtaaactcaaggatttccctacaatcaaacaaggagcttagaattattttgagtaaaacaaaaggctagaatcaagcgttttcctatgctagagtaaagggagaagataggaggagagaaatgttttggttgaatggttaatgcaactgtccccgtggcaccaggctttggctggtactttatttacatacgccatgactgctctaggtgcggcacttgtttatttttttaaggatatcaataaaaatgttctgaatacgatgttgggattcgcttccggtgtaatgattgctgcgagtttttggtcattactagaccctgctatcgctcgtgcggaagaaaatggggatatcccatggcttgtggttagtattggttttggattgggtggactatttttatatgctgcagacaaaacattaccgcatatgcactttggtcctaaccatgaaacagaaggctttccaagccatttaaaacgaacgattctgttggtcttctccatcacattacacaatattcctgaaggcttggcagttggtgtggcttttggagcagccgccagctcggaagatcctcgggcagcagttttggcagctatttcagtagctataggtattgggatccaaaattttcccgaaggagctgctgtatccattcctttaagacaggaaggattgagtcgtaataaggcctttgtctatggacaagcttctgggatcgttgaaccgattgccggtgttataggcgctttgctggtaacaagtatgacagccgttttgccatatgctttagcatttgcagcgggagcgatgatttatgtagtggtagaggaactaatacctgaagcacaacaaacagctagtagtcgacggcattttgcagtttttggtgttatgacaggcttcattctgatgatggttttggatgttgctttaggataatcaaaaaagacttggaacagataatgctccaagtctttttgttagttatagtatttttttggtcgttgtcgaacgtttgtcagccaccgaacaattagaacagctaacaataaaggaataccaaaacgaaaaattaaaccaatcaatccgccaatcaatccgccaattaatcctaagacgagagataagagcaatgaagccagaactaaaactgctacaacagttacgattttacctaacaaactttgtgtattcataataaatcctcctatacctttttcttaaatttattttatcaagaaagaagaggtggaacatccatcttaaggcggaattttttctccgtcggtagtcaaagagatgttagtgaggtaaactggtaaaaaaaagcaggtgagaacatgaaagcaattatcaaaagtaaacattttattacggaaggagggtgcaatgcttgccaggcctttgagttagaaacgtttacgatgcacttagagaatggtaaagaagtttctgtagaaaatctggacgtagcatctttagtaatgccacttatccaaaatgagcattggcagacagcgctattattagacgaagaagagggctacatttttcgaaaagagaatcaagaagtgaaatttgtggataatgatgctacacaagtatttgtttcaaaagaacaaagaattgtttgtcagaaaaaagcctgtgatcaggaattgtttacagaagcaaatgcagttttacagcaactcttcgctatggaaccagttgaatttgtaattgaacaagcataatcaatcagaaaagcagcttgaaaaagaaactttcaatcaaaagtgaaaatcacttaaagattgaagtctccggaatcaagcagcttttttatttacgtatttgaccttctccatagataatatatttggtggaagtcagagcttcgagtcccattgggcctctagcatgcaatttctgagttgaaatgccgatttctgctccaaaaccaaaaacaaacccatccgtgaatcgtgtagatgcattgacatatactgcagcagcatctacttcttgtaagaatttctgagaggcaaagtagttatccgtgacgatagcttcagaatgcttagtgttgtaatgattgatgtgggcaattgcttcatcgatggaatctacaactttgatggctacaatataatctagaaattcggtttgccaatcttcttcagtagcaggttgcgcatttattaaatagtttcgcgcgttagtatcagcacgcaactctactttatttttcagttctttttctagtaaaggtagaaagtctgctgcacaacttttatgaacgaggatcgtttcgattgcattgcaaacagaaggtcgctgagttttggcattgacaacaatgtcgacagccatcggaagctgtgcatctttgtcaataaagatatggttgttacctgttcctgtttcaatgacaggaactgttgctgtttctttgacacgacgaatgaggttagcaccgcctcgtggaatcagtacatccaagtacttgttcaagcgcatcatttgatcagccactgcatgactggtgtcatcaacaaattgaatagaatagggtgaatatccattggcgcttaatgtttcttgcaaaagatttacaaggatttgatttgagtagaaggcttctttacctcctcgcaaaatgacagcattcccagatttgaaacatagaccggcagcatctgttgtaacattgggtcttgcttcataaataattcccacaacacctaatggtacacgttgtttaccaattaagagattatcactattgcgccacattttgtccacgattccaagtggatcagggagctgaacgatttttcgaataccagttgccatctccttgattcgttcatcagttaattctaggcgatcaattaaagttgaatttaatgcatttttttttgcagcagcaaggtcttttttattttctgttaaaattcgtgaacgatttctttcaagtgtatcggccatagctgatagtaagtgatttttctcagtagcggttagtaagctaagtgaggccgcactcttttttgcttgctttcccaattgcattaaatcgatcataatgtttcctccttgtaaaagtaagtgccaacctttttgccagctaagatatcaaaaatgattttaggctgtttcccattcgccaagatcattgtggcatctgttttgagaatacgatccgcagcttttaatttgcttgacatgccaccagttccatacggacttccttttccggtagcttgtttcattaaatcaggtgtaatctcagtaatttcatcataaagtttagcagttttatgatgtagcggattagcagtataaaacccatcgatgtcggatagcataatcagcagatccgcatggactaactgcgctacaattgcagataattgatcattatcaccaaatttagtaagatggtccaactcatctatggcaactgtatcattctcgttgattattgggataattcccatcgctaagagctgctccaatgtattacatacattttctcgactttgaggaaactcaataatatctcgagtcaacaataattgagcagttttttgattgtaaacttgaaaacggtgattgtaaatattcattaattcggcttgccccacggctgcaacagcttgttgctgggggatttctacaggacgttgtggaatgtttagtttattcatccctacaccaatagcaccagaagaaacgagaataatctctttgttttgattctttagatcggacagaacaaaagccagttcatcaatactcgagaagttgatatttccattgggatagacgagggaactggtcccaattttgataacgactcgattcgctttttttagtttctctcgcatggatgtaaccacctcttctgaattcagtaaataatattttttctattgtactagcaaaatagcctttcgtcatgtcctttttctattttcttcgtttttttgactgcggaagcgaagaaaatataaagagtttctgttaattttgttttcattaaagaaaacaagggttactatgctaaaatgactatatgtttattaattggaggaaaagatgaagacacgtggatttgaaattgtttcaacatatgcagataaggatatagctcttccgcaacgcgcaacacaccatgcggcagggtatgattttgaagcggcagaagaagtcgtaatacctagtatatggaaagcggggttgatgaatggcatccaagcgttgacagctaaagatgttcaaaaagcaatcaaaccgacactggttccgactggaatcaaatcatatatgggaaaagaagagtatttacaattaacgaatcgttcgagcaatcctctcaaacgttttttgttactaacaaatggtgtcggagtcattgacagtgattattacaataattctgataatgaagggcatatcatgtttcaatttacgaattttggtcccagtgatttgaccatcaaaaaaggtgaacgaattggtcaagggatcttcttgccgtttttaaaagcggatcaagatgtaaccagtcaatcacgctctggaggatttggttcctcagatctgtgattgttcgatatacgcatgcagtcagtcctagataacgaattggaggtttgcaatggctaagaaagcaaagagtcagtttgtctgccaaaattgcggatattcttcaccaaagtatttagggaagtgccctaattgtggtagttggaattcgatggtagaagaagtgattcaagaaacaacggatcggcgagtacggactactcttacgggacaacggatgcaaccaacaaaaattgctgatgtcataccaaagaaagaaccacgagtacagaccaaactagcagagctaaaccgagttttgggtggtggtgttgttccgggatcattgattttgattggtggtgatccaggaatcggcaagtcgactcttttactgcaagtctcacagcagcttgcagctattggcggcaaagtattgtatgtttcgggtgaggaaagtgcagagcagataaaaatgcgtgcccagcgtttaggagccattgatacggaattttatttatatccagaaacggatatgtctgagataagcaaggcaatcgaaaatctaacaccggattatgtcatcatagattcgatacaaacgatgacacaaccagatatcactagtgtggcaggaagcgtgagtcaggttcgagaaacgactgccgaacttctaaaactggctaaaaccaacgggattgctatttttattgtgggacatgtaaccaaagaaggttcaattgctggtccacgaatgctagagcacatggtggacaccgttttatattttgaaggtgaaaagcatcacagcttccgtattttgcgtgccgtcaaaaatcgatttggttcgacaaatgagattgggatttttgaaatggaagcaggcggattgaaagaagtagccaacccctctcaagtctttcttgaggagcgattagaaggcgctacgggttctgccatcgttgttgcaatggaaggcagtcgaccgattttagtagagatccaagctttggtgacaccaactatgtttggtaacgctaaacgaacgactaccggattggattttaatcgtgtttcattaatcatggcggtccttgaaaaacgggctgggttgcttctacagaatcaagatgcttatttaaaagcagctggtggtgtaaaattaaatgaacctgcaatcgatttagcaattgcagtcagcatagcctcaagttataaggaaaaaggtacgagtcctacggaatgttttatcggtgaaattgggttgactggtgagattcgacgcgtcaatgcgatcgaacaacgggtaaaagaagtgcaaaaattaggatttactaaagtatatttacctaaaaataatcttactgggtggcaaccgcccaaaggtatcgaagtagaaggcgtgtcaactttatcggaaaccctacgaaaagtttttcgttaattctgataaggtgttagttaaaaaaaaaagaataaattcgaagatgagacgaaaataacgaaattatcagaacaagaatgaatgaagactgtttattgagaactatttgcatcagaaggtgctatctttgtccagctctttctaaaaaagattttttcgtttatgagtctcagcttcgtactaaattagtttggaggaacgtgtatgcagaaacgagtcattactgcgctaatggttcttgctggagcaagtttaggtatctcattaatgcctgttgcatggcaaaccattggtcaatcaaaaaatgaatggctgaacaataatatcactaatagcttgcttggagcccttattttctttttattatctttgctattagcgaaatatattgcagctggaattcgtaaaattgaagaaaaattgagtgaattgagtctaacttatttattatttggagcaatcggatcaattattggtttaatgatcggggtcattgtatcgattcctttttataattgggatattccttttattaacggaatcgcgcctattttagtaatggcgttgttgggatatcttggctttcaaattggcacgactcgaatcgaagaatggaaaaaaatcttttcttctaaaagcaagaaaacagaacctgttgaagaacaacagatgcttgatcgtaaaatagctgatcattttcataagtataaaattctcgatacgagtgttatcatcgatggacgtatctacgacattgctaagacaggttttcttgaaggggtcctattaattcccaattttgttttatatgaattacaatatattgcagattcaggagacagcttgaaacgtgtacgaggtcgacgtggattagatattttgaatgctttgcaaaaagaagaaggtatcgctgttgaaatgtatgagggtgacttcgatgatatttctgaggtcgacagcaaattgatcaaattagcaaagatccttgatggtattgtggttacaaatgactataatttaaacaaagtttcagaatttcaaaatgttcctgtgttaaatatcaacgctcttgcgaatgcagttaaaccagtagtgattcctggagaaacaatgaatgtacttgttgtaaaagctggaacggaaagacaacaaggtgtcgcttatttggatgacggaacgatggttgttgttgaagatggacagcattacatgaatgaacatatccaagtagttgttacgagcgcactgcagacagctgcgggacgaatgatatttgctaaaccggctcattcaagtcgtggaatcgataatcaggatgacacaaaaaattagcaataatcaatggcaattggcggattttacgccggttgcctttactattttgcttaatgattgtacaattctagctgagcgaactattttattatcggagattttccctataagctagaaggtaaaaaccgaacagcaaaggattgtttgcaaatcagatgaaggaagaggaaaaagatgactaaagtgcgagtacgttatgctccaagtccaactggacatctacacatcggaaatgcccgaacagcattgtttaactatttatttgcacgtcataacgatggcgaatttattatccgtattgaggatacggatcaaaaaagaaacattgaagatggtgagaagagccagctagagaatctcgcttggttgggtattgattgggatgaatcccctgcaaaccctggagagtacggaccgtaccgccaatcagaacgcggtgagttgtaccaaccattgattgatcagttgctagcaagcaatcgtgcctataagtgttattgtacagaagaagagctagaagcagagcgtgaagaacaacgcgaacgtggcgaaatgcctcattatggcggaaaatgcgctaatctaacaccagaggagcaagcggaaaaagaagcacaaggtatccaaccagttattcgtttccgagttcctagaaatacagagtataagtttcatgatatggtaaaaggtgagatcgtttttgagtcagataatgtaggcggcgattttgtcattcaaaagcgcgatgggatgccaacatataactttgcagtggcagttgatgatcatcatatgaaaatcacacatgtattgcggggcgatgaccatattgctaatacaccaaaacaattgatgatctatgaagcatttggttggcaagcgccacaatttggacacatgacactgatcatcaacagcgaaactggtaaaaagctaagtaaacgcgatgaatcaattttacaatttattgagcagtatcgtgaattaggatacttaccagaagcaatgttcaattttatcgcattgttgggttggtccccagtaggagaagatgagttattttctcaatctgaattgatccaaatgtttgatccagaacgcttgagcaaatcaccagcggcttttgatgccaaaaaattggagtgggtcaacaaccactatatgcgtcaaatggacctggatcagttgacagaaatgtgtttgccatatttaatcaaagcaggtcgaattgaagaagagccttccgtagaaaaaagagaatggctgaaaaaaatcgtctcactatatcaaccacaaatgagttatgctgcacaaattgtggaagtttctgagttattctttaatgaacatcctgaattggatgctgctgcgcaagaagtcttggcgggtgaaactgttccaactgtactcaatgcctttaaagaaaaattgactgcaatgactacagttgacgcaccaacagtaaaagctgcaatcaaagagatccaaaaagaaacaggaatcaaaggcaaaaacttgtttatgccaattcgtgttgctgtctcaggacaaacgcacggaccagaattaccggatacagtagaattactaggaaaagaaaaagcacttgatcatttaaataatgtattataaacacgaagaatagacgaagtacttaccttttttttgaagagagatcacgggtggtgagagtgattaaaaaaagtaaggaaatgcacctaggagtggttttggcgcaagtcaaaaacggcagcagacgttacctgcaccaaggcagaaaattctgtgaacaaaagtggaaccacgtggttgagcgtcttttgaataaggaaacttatttgaaagatgcttttttgtatgtaagtaatcaataggggaagcaggtgagaagatgacttggacccaaaaagcaattgcagcagcgaaaaaaaatgacccttcagctcgatcaacgctggaaatcgtattgtcttatccgggctttcacgcattgttttggcatcgctggtcgcattttttatttcaaaaaaaactctttcttctagctagactcacatcccagttttggcgttttctgacaggcatcgagattcatcctggtgctcagattggcgaaggggtttttatcgatcacgggatgggtgttgtaattggagaaacagctattattgaagatgacgtcgtattatttcacggtgtaacactaggcgggacaggtaaagaaaaagggaaacgccacccgaccataaaaaaaggggcattcatttcagctcatgcacaaattcttggccctgtcacaataggggaaagcgccagaatcggtgctagtgcagtggttcttagtgatatcccaaatgaagcgactgctgtaggaataccagccaaagtcgtaagaatcaaaggaaagaaggttagccaagatgatcaaaatttataatacgttaacacgtaaaaaagaagttttccaacctctcgaacaaggtagggtgaaaatgtatgtttgcgggccaacagtttacaattatatccacgtcggcaacggacgtagtgtagtatcttttgacacgattcgcagatacttagaatatagagggtatgaagtcgattacgtaatgaacttcaccgatgttgacgacaaaattattcggaccgccaaagaattgaaaacttctgctccagaaatagcagatcgttttatcgaagcattcaataaagatactgcggctttaaatgttcaaccagctacattaaatccgcgagtaatggatcacatcgaagacattattgcgtttattcaagtattagtagataaaggatacgcctatatggcaaataatgatgtgtattaccgtacacgtaaattcaagcactatggtcagttaagtgatcaatcaattgatgaattagaagttggggccagtcaacgaacgggtgaagaacaaaagatcaaagaagatccgttagattttgctttgtggaaagcggctaaggaaaacgaaatcgcttgggattcaccatggggactaggacgtcccggttggcacatcgagtgctccgttatggcaaccaaacatttaggagaaacaatagatattcatggaggtggacaggacctgactttccctcatcatgaaaatgaaattgcacagagtgaagcgaaaacgggtaagacgtttgctaattattggatgcacaatggttatgtcacgattggtgaagaagaagaaaaaatgagtaaatctttgggcaatttcgttactgtccatgaaatggttcaaaaaattgatcctcaagttttgcgcttctttttggctactacccaatatcggcgtccaatcaaatacagtgaaacgacattgaaagaggcagaaacaaatctgcaaaaattgagaacagccttagaaaatgcacaatttcgtttgcaaaatagtaaagaaggattcccagaaggaaccgaccatgccatcttagcagaatttgaacagcgttttgtacaagaaatggatgacgattttaatgcagcaaatggtatcacagtagtatatgaacttgcaaaatggttgaacacttacagtgaaagtgcttcaatcgatatagaattattgactgctgcagttgaaaaattcaaggaatggctagccatctttgggatttactttgtgggtgaggaacttttagatgaagagatcgaacaactaatcgaagaacgtatccaagcaagacaagcaagagattttgcccgaagcgatgaaatccgggatgtgctaaaagaaaaagggattatcttggaagacacagcgcaaggtacccggtggagaagagacgcatgagagattacaaacagttgaacggactagcgttagcctatattggggacgcggtctatgaagtatacattcgggactatttgattgaacaaggacaaacaagacctaatcagcttcatcatatggcgacacactatgtatcagcaaaagctcaggcggcattgatccaaaagatgcttgatgaagaaataatgactgaagaagaatatgatttttaccgtcgtggacgaaatagtaaaagccataccagtgcaaaaaatgctgatgtaaccacctatcgcattgctacaggctttgaatccttaattgggtatctacacttaacaaagcaacaggatcgtttagacacgctcgtagcttggtgtatcaagaaagtaggggaagaagatgagggaaaagaaacaaagaaaaccgtcgcgtcaaaacacggtaaaaaataaacagcacactagaaagaattttcgtgaagaaacaactgaattgatagatgagaattttgtattcggttatcatgcggtaattgaagcgttgaaagaaggacgcgggaataaattatttatggcagaggatgccagaggggaaaaaatcgatgggttaaaagaagctgctcgcgcacagtctgtcccagtcaagtgggtgccaaaacaaaagctcgatcaaatgagcaatcaaggcgtccatcaaagtgtgattttagcgatcaccccttatgaatacctatcactggatgaattattggcacaaacaaaagagcagtcattctatttgattttagacaatttagaggatccacataattttggttcaatcctgagaacagcggatgctagtggggtagacggaatcattattccgaaacaccgtgcagtaggaatcactcctgtagtcgtgaagacttctactggtgctgtagaacatattccgattgctcgtgtcaccaatttaagccaagcgattcaacaactaaaacaagctggtttttggatttttggaacggatatgaaaggaactgattaccgtttgtggaatgctcaaggggcagcgggattgattatcggcaatgaaggtcgaggaatgagtgaaggattgaaaaaagatgttgatgagatgttgactattccgatgactggtcatgtacaaagtttgaatgctagtgtggcagctgggttattaatgtatcaagcttttactagtcgaaatggggcgccgcaatgaaaacgcccctgctaatcgtcgatggctataatatgattggtgcttggcctgaattagtcttattaaaaaaccaagatcgtttagaagatgcaagagaggcgttattgcatcgattatccaattattcaaaatacgaaggattaaagattattgttgtatttgatgcgcaattggttcccggtgttactcaaagctatagtaaatatcagttacaagtcatctttactgaagaaggtgaaactgctgacagctatatcgagcgcatcgctggagaattgaatgaccgtttgactcaagtaacagttgcaacgagtgacttagcagaacaatgggttgtgttttctcaaggtgcgttgcgaacttctgctcgagagctttataaaagtattgaaaaaacagaagaagcaatccatcagcatcaaacagacatcaaatttgaaaattttcgcagaaactctccttggacgcctgaacaattagctgaattagaaaaaaaactgcatgatttgagttagggacaaagttggttcgttaaatgagaaactaatgaacaagaatatgttacgctctttttgtaccaaaaattaagcataaaaggagcgtaacaaaatgaaatcaaacgaatcaatcagtaggagttcagaagaatttgaagcaatgtttttcaagtatcgccctatcgtcgagattatgtacaaaaaatattatctcaaagattatgatttagatgattggatgcaagaaggccgtattgtttttaacaaatgtctgcaggcttatgatgaaaaccgtggaacaacactaggagttttgttcaaacgctcgtttgaaaatcgcgtctgcagtttattacggttgcaacaagcacaaaaaagaaaagcacaattaaattcttcttctcttgaagaaaaaatttctcatgaaggaccaaattttctctccgatcaaaatgaacaaactgaaaaagcggagaagtatttaatgcttcaagaaactatgaataaatacgattcgccattttcgaagttagagcaaatcgttataatgaattacttgaaaggattagaacttgaacaaatcgcagaacaaacagaacttccactgcaacaaattaaaatcgcttacaaccgcggtaaaaagaaattgagagcgcttcttatgaacccttagagaaaatcttattgaaagaataattattttatggtaaacttgaaattttctgtaaattatagtatactgttgcttgaggtgaatgcgatgccaacaactttagcaacaatcaaaaaagatttagaaggtcgtataggcagtgaaatcatgctagttgctcaaactgggcgtaaacgtcaaacggaacgccgtggtgttttgacagaaacatacccttctgtgtttgtcgtggatttagatccaaacgaaaattcgttcgaacgtgtttcctatagttattcggatattcttactcgaacggttgagattgaatttttaacaaaagctgtttgatcagaaaagggctgacaaaatgttagctctttttttgtattttttattattgattagttaggagatagtagaatgattgttatgataaaagagttgcatgagatgaccggattagaatttcaccaaatcgctgctttacgtactcaagtgtttgtcgtagaacaaaattgtccctatcaagaagtagatgcaattgatttgattgctaaacatctttgtatttttgatgaacagcaacaacttgtttcttatgcaaggatatattttatcgaaggtacggttcattttggtcgagttttagtaaatcctctgttccgtggacaagggcatggggatcaattgctacaagaaatcatcaaacaactaaatcgtttctatccaaatgctccgattgaaatcgaagctcaagcgcatttgcagaaattttacgggaaatataattttgtcactgtttccgatccttttgatgaagatggaattttacatgtggttatgagaaaagagaaataaaagcagtcattacttataaaaaaaaagatgaacaaatcatgaataactctctgctctgacatgtatttgccagagcttttctgatttcaagagctatccattattgttcgaatcattctaaaaaactatctagttaaaaggatcacggtttatatcattagttgtgatattggtacgggattctgtttgtactttcaataagtcacgaatttcttgaagatagtcttcggcagtaacttctggttcttcttcttcaactggtttttgatgaagattgcgcaatttattcacagctttaacgattaagaatagaacaaaagcagtaatcaagaatgtaataattgcagtaatcacttgaccgaaattaaagacgacattttttttaggctcccaaacaagccctgaaaatgcatcttcgctgccgaaaaatgaaaataccagcgaaactaatggtgttaaaagaccttctaccaaactggtgacaatcgctgtgaaggcactcccgatgacaaccccaacagctaagtcaatcacatttccgcgcaaaataaattctttaaattccttgatcataaacaaacctcctttaaatttattcttagtataacgaataaacgatgatttataaaaatatacgcccgtaaaatgagtaatttttctggaaaaattctgcattatgctataattgaagagatgatttttgagaggataagaggtgcattatggcaattgaactaaaaaaaaatgttcgactcacggttttgccgactaaaaaatataaaacaatccgtgtttttattcgatttacttcgcaattagcggctgaaacggctgcgaaacgcacattattgacgagtttattagagacaactagtttgcgttatcccactcaaacagcctttagtacgcaactggcagaattgtatggagcaagctttggcatgaatgttaataaaaaaggggatcttcatcaagtcaatgcagcgatgtcgttcgtcaacggaaaatatgttgctgatgaagaactatttacccaagctgtttcttttttgaaagaagtgctttttttcccaaatattgttcaagatgaatttgaatcaaaaaattttacgatcgaaaaaagcaatttgattgcttatatgagaagtattgctgaggataaacaggcgtttgcttcattaagcttacaagaattatttttttcaaaaagtgacaatcaaaaatttccaagttttggtcgtcctgaagatttggaagatgtgacggcaaaagaactaacagaaacatatagttctatgattaaagaagatgctgtagatatttttgtgattggggatgtcgaagaagatcaagtaattgaagttatgaaggatctcccctttgaaaatcgtcctgaaaaagatctttctgttttttatcgtcaagatttggaaaatattatccgcgagaaaatcgtcagagagcctgtgactcaggcaaaactgaacttaggttatcgtacgggtgtttattataatcaaccggaacgtttctctctcatggtttttaatggattatttggcggatttcctcattcaaaactatttatgaatgttagagaaaaagagagcttagcttactatgcatcaagtaatgtggatacatttcgaggttatttatctgttcaaacaggaattgatggcagtaaccgggatcaagtctttactttgattgaacaacaacttcaaagtttacaaagaggagaaattacagaggctgaattggcacagacaaaagctatgcttaaaaatcagtttttgttatcgttggatagtccacagtctttgattgaaacagaatatcttaatcagtgggtaccgaatactaaaatgagtgaagagcaatttatacagcgtttggaagaggtatcggtcacagatgttcaaaaaattgctcaaaagatcgaacttcaagccgtattctttttagataaggagcttgatcatgaataaaaaacattataatcaaataaatgaagtcttgtataaagagatattacccaatggattaacagtttatttattacctaaagaagggtttcataaaacatacggtctttttagtacagattatggttctatcgataatcattttggttatgcgaatgaaacgatgcatactgtaccagatggtattgcccatttcttagagcataaactttttgaaaaagaagacggtgatgtctttcaaaaatttgggcaacatggagcatcagccaatgcatttactagcttcacaaaaacgagttatcttttttcggctaccaatcaaattcgaaaaaatttagaaacccttttagattttgtacagatgccttattttacgaaagaaacggttgagaaagagaaaaggatcattgggcaagaaattcagatgtatgatgatgatcctaactggcaacaattttttggtgtcattaagaatctatatccaaagcatccgcttcacattgatattgctgggactgttgaaagtatagcagccatcacagcagaagatctttatctgtgctaccatacattctaccacccaagcaatatgactttgttcatagttggaaacatcgatccagaagagacaatgaactggatcagagaaaaccaggcagcaaaaactttttctgcagcaaaagaaattaagcgtcaatttccggaagaaaccgttcaagaaattattccagaaagtattatgaggatgcccgttacgcgaccaaaaggtgttttgggtatcaaagggaatatggagaaacgtccgacggaaggtcgggagttgctacgatataaacaatctttgaatttattgttccaattacttttaggtaatacttcagctaattacttaaggttgtatgatcaaggaattattgatgatacgtttggtttcgaagtaagtttggatcgaagtttttactttgctgatttttctggagatgcagaataccctgaagagatgcttcaagcggttgaagaaattttattgaattatgaaaatgatcctgaaatgaacgagaagaatcttgagttacttaagaaaaaaatgctgggtaaatattttcaatctctcaattcattagaatttattgctaatcaatttacacaaagcttatttggcgaaacaacactctttgatttgccagatgttatacgttcaatcacgctcaatgatgttcgatctgctgctaaagtattcattgatcaaaaagcattcagtcggttttacttgctaccaactaaaactaactgattaatcgtcattgtgtaagatgccgtctatgcattttctgatagatggctcttgtttttgtagaagaatgagtaatgagatcaaaaagtattaaattttgtttgcgacttgtctgaatgttatcctcagtcaattttttttatggtattctttaaatgatactgattgaacaattttcatttatgatgaaaaatcaagagtaaaaatgttatatttaataaacaacctatcaattaagcaatccaaggatgacaaggagaaacgaagtggatttccgatccaagtgtttgccttccataaaatgaatagtaaagactggagtagatgatcgagtggccaacgaaactacgattggagcaaaattacggcaagcccgtttagataaacatatttcattagatgaattacagcaaatgacaaaagttcaaaaaaggtatttggaggcaatcgaagccgatcgttttgaacaattaccaggaactttttatgttcgtgcatttattcgtcaatatgccgccgctgtaggtgaggacggagataagttagtttctgtatttgatggaaaagatacattggcagaaccactgcctaaaagacctcaacctgagaccgtaagcggatcgagaaaagctttgcatgtagaggaaaaaggcggaacgtttttatcccgctacttaccaatgattttattaggattagtagcagtcactattatctgtattgttgggtatatggcttggcaagacagacattcaacccctatgattcaaggtagttcggcaccggtggttgagaattcagcctatacatcaacctcaagcacggtggaatcgacagcaagcaaagaaacgagcgagtcagagactcaatcttctagcagcacagaatctagtgagaaagaaatgactatgaccaaaggggaatcttcccaatcagatatcagcatttcaattaaagatgcgacgaatccaattaaattagagttaactggattagatgcctcgtgttgggtaggcattcttgtagacaatgcgtatgtctaccaatatactttacaagcgggcgaagtccaatcgacgacattgccagaaaatgcaaccaatgcaaccattgtacttggtgcaagtcaaaatatccagattgcggcaaacgggcaaaaaattgatttcgatgatcctcagtataaattgctccaaaaaaatgtgcatttagcgattgagtatcaagaaacaaactgatcagaagaacgattaattagttagaaagataacattgttcctatggcaagtgctgtagtagcatgatttccgtttttttcgtacaatatttgtcagagaggagcaaattttttgaatttacctaatcaattaactgtattacgcatcataatgattcctatatttattttagttttggcgttgccaatcgatttaggaacattggacgttggaggcgtcgatttactcacaacacatctgatagcagccattctatttgctgttgcaagcattacggattggctggatggtaagattgctcgttccagaggattggttaccaattttgggaaatttgccgatcccttagcggacaaaatgctggtaatgactgcatttattatgttagtcgaattggataaggctccagcttgggtagtctctatcatcatttgtcgagagttagcagtcaccggtttaaggctcttgttagtagagcatcatggtgaagttcttgctgctgcttggcctggtaaaatcaaaacagcaacacaaatggttgccattattttcttatttattaacaatcttcctttttcactcataggcattccattggatcaaatcatgttgtatgtatgtttgatctttacaatttattctggaatcgattatttcattaaaaatgccagtgtttttaaaggttcaatgtaatttctaaaagttcagaggaattctgaactttttttgtaaaaaaaatcaattacaacgtagttgataatgaaggagtaatgaaatgaaggcagagattattgcagtagggaccgaattgcttttgggacaggtggtgaataccaatgcaactttcttatcagaagaattagctagtttaggaatcgaagtttactatcatagtgttgtaggggacaatccaaagcgtttggaagagctagtaacacttgccgagaatcgcagtgacttgatcgtattttgcggtggtctcggacctacagaagatgatttaaccaaacaaatcgttgcacagcatgtcggtcaagagctcgttcgtgacgaagcagggtatgagcaaatgctgacctttttcaaaaatggtcagcgttttatgacagaaaataatttgaggcagacgttggtattcaaagatggtacagcgttacctaatgcaactggattagcaatcggtatcttctaccgaacagctacagcggcatatctcctgttgcctggaccaccaagtgaactgaaacctatgtttatccaacaagcccgtccaattttgcagacagagttttcatcagaagaacagttgatttctcgagtattgcgattttatggaattggagaatccgcactagtaactgaacttgccgatctaattgattctcagaagaacccaacggtcgcaccgtatgctaaacccaatgaagtaaccttgcgtttgacggtgaaaactacggatgaatcggcaggacaagccaaactagatgaattagaacaacaaatccaagcaagagtgggcgaatatttttatggatatggagagcatacttcattagctgaagtagtcgttgatatgttgaaagaaaagaaaaaaaccgtgacggctgcggagagtttgacagcgggactctttcaagcgacgctgggagacatctcaggcgtgtcccgtgtattttctggtggttatgtgacttatgctaaagagacaaaaagtaagatgctaggaatcaatgaagacttgctaacagcttatggaactgtcagcaaggaatgtgcagaagcgatggcgcttgctgcccaagccaaagaaaaagcggattacgccctttcttttaccggggtagctggaccagatgagcttgagaatcaacgcccaggaacggtctggattgctttagcaaccaatgaaggtgtgaaaagcaagtgctatcatttttccagagatcgtgcatacgttcgtcatagtgcagtaatggcaggattagatctattacgtaaggaattgttaagatgatgcgaatgtttgttcgttttttcttgcatttttttaaaagaaggactattattaacatagtaattgacacacgaaagtgaagaaaataagggggattatccgtttggcagatgatcgtaaagcagctttagatgctgcactgaaaaagattgaaaagaactatggtaagggtgccattatgaaacttggtgagaaagtcgatcaacaaatttcgacgattccaagtggttcattggctttggatgttgctttaggtgtgggtggttatccacgtggacgtattgttgaagtatatggaccagaaagttctggtaaaaccacagttgctttacacgcaatcgctgaagttcaaaaaggtggcggaacagcagcctttattgatgcagaacatgcattagatcctcaatatgcacaaaaattgggtgtaaatatcgatgatttgctgctatctcagcccgatacaggtgagcaaggtcttgagatcgctgatgctttagtatcaagtggagctgtcgatattgttgttatcgactcggttgccgctttggtaccaagagctgagatcgatggtgagatgggtgatacccacgttggtcttcaagcccggttgatgtctcaagcattgcgtaaattatctggatcaatcaataagaccaaaacaattgcgatttttatcaatcaaattcgtgaaaaagttgggatcatgttcggtaatcctgaaacaactcctggtggacgtgcgcttaaattctattcgacgattcgattagaggtacgacgtgcagaacaattaaaatccggaacagacattatcggaaaccggacaaaaatcaaagttgtcaaaaataaagtagcgccaccttttaaagttgctgaagtagacatgatgtatggacaaggaatctctcaagagggagagttgcttgatatggcagtagagcaagacattgttgataagagcggtgcttggtatgcttataaaggagatcgcattggtcaggggcgggaaaacgcgaaaaactatatgcgtgaacatcaagaaatgatgatggaagtttctgctcgtgttcgcgatgcgtacggcattggtaccggagaaacggtcattgaaacagaagatgcgcaagaagaactaccattagacgaataagatcgtttaacgataaagaagaagccaaacattcaagtgtttggctttttttgtacagtaataacagatctgctcataaaaactgcacgttaaaatgaaacctataggaggtgagggagcgtcaataattttgtgtaaatgattcttccctactgcagattgtttctaattctcaatcagttggcttagcatttgttcaagttcgccttcggcctgttgaaagcctttatgactgcgacctaggaatttttggttgtaagtatcaaaagacgagactaagaaacgttccatcgactcttcgttttggaactgttccttgcggtggctgtatttcttgatttgcttattaaaggattcaatcaagttcgtagaataaatactcttgcgtatggccaaggggaaatcatagaaagtgagcaagtgatcgttcgaaagaatcgattcaaccacttttggatagctggttttccttttttccgcaaaagcaccacgtgcttccaacgccacctctttagatgaggcttgatacaccattttaaaatcatcacagacttccttacgatcatcgacacgcactttgtgactgatattacgggaaacgtgtacacaacaatgttgaaaacgagctttgggatagaaccgactaatcgctcctaccatcccctttaagccatccgtgatgaacaggaggacatttttcaaaccgcgctcttgaaggtccaataaaatttcctcccaaatcgtgatggattcagtcggtgcaatcgcatagctcaatacttcctttgatccgtccgggcgaatgccaactgcgatatgaatagcttccttggcgacggttttccgctttaacggaatatacgttgcgtccatataaatagcagcataacggtcatgaagctcccgccctttaaacgccgttacctcttctgtaaatgattttgttatattggacatggtttggggcgtgtagtaatgcccatacattttctcaatcaagtctgcgatttccgacatggtaataccttttcggaagaggtgaatgacggtctcctctaacgtgtcattcgtccgtctataagcaggaacagtctgttgcttgaactcaccattgcggtcgcgcggaatctggagatgaagttccccatactcggtcttgaccgtacggtcataggagccgttacgagaattacccgtgttaaaaccaatgcgatcatacttttcgtaatctaggaaagccgttaactccgttttgagaagcgtattgactgctttctccaaatggacacggaataattcattcaaatcgcctttgttcgctagagtctttagaatttctgtagtaaaatcgttcatagggaagtcctctcttctgtgaatgtgttgtggtagctctattctacagaagggacttccttttttctatttacacaaaatattttacactctcggaggtgatgtacataggatttaaagttgacactcttgtgtacaaacattagaataaacttatgtgggtttccacatagcagtaggcaacttgataatttattttaatttgtttatcaaaactacaaaatattgtaaaagatagtatggaggtggattcattggaactactttacattctcctcgctatcatcggtttaattgtcggtcttggattaggagtttttgtgaccaaatctcgtcacgaaaaagagatcaatggcgcgcaaaattctgcaactggaattatcgaaagcgctaaaaaagaagcagaaactctaaaaaaagaagcattgttagaagctaaggaagaaaatcagcgttatcggtcagagattgaaagtgagttgaaagaaagcaaacttgatttaaaatcacaagaaaatcgcttgctccaaagagaacaagtacttgatcgcaaagatgattctttggaaaaacgagagcactcactggaagaaaaagaaaacagacttagtgagaaacaacaattaattgacgagcgagaaaaagaagtagaaaaactaatcgatgggcaacagcaagaattagagcgtattgcggctttgtctagagaggaagccaaagagttgatcatgaaatcaacggaagaagaattgaatcatgaattaacgattatggtaaaagaatcagagcaacgtgcaaaagaagaagcagatcgtaaagcgaaaaacttattgtcattagcaattcaacgttgtgctgcagatcaagtatcagaaacaacagtatctgtcgtatcattaccaaatgacgagatgaaaggtcgaatcattggacgagaaggacgcaatattcggacattggaaacattgaccggtattgatctgattatcgatgacacaccagaagcagttgtactatcaggattcgatccaatccgtcgagagattgcacgaatgacattagagaaactgatccaagatggacggatccatcctgcacgtattgaagagatggttgagaaatcccgcaaagaaatggatgaacacatccgtgaatatggggaacaagcagcctttgaagtcggtgcacataccctacatcctgatttgatcaagatattgggacgtttacgctttagaaccagttatggacaaaacgtattgaatcactcaattgaagtggcaaaactttcgggtgttctagctgctgaattaggtgaggacattcagttagcaaaacgtgctggactgctgcatgatattgggaaagcacttgatcatgaaattgaaggctcacatgttgagattggtgctgaacttgctgccaaatataaagaaaatcctgtagtcattaacgcaattgcatcccaccatggagacgtagaagctacttcagttatctctgtgctggtagctgcagcagatgctttatccgctgctagaccaggtgcacgtagcgaatcgttggaaaactatatccgtcgtttacaaaacttagaaaatattgcgaatggcttcaaaggtgtagattcaagttttgctgtacaagcaggacgagaagtacgagttatggttaagccagaagagatctccgatttagatgcggttcgtctagtacgtgatatccgcaaaaaaattgaagatgatcttgattatccaggacatatcaaagtaacggttattcgtgaaacgcgagcaactgattacgctaaatagcataaaaaagaaccttggcttttaaagccaaggttcttttttatcaaatagtttagccctcgttagcaggattaaaattaatcaaagccgcctagtacttaagagaggttagatttttcttctgcgcgcaaagtctacaaatcgaaatttatctaagcgatgtatcgattcagtgtattcaaaacagcgtgtgtcttcaagataaaccaaactacgtacagtaacaacatgttgatcatcaggatgaaggtccattaaatctcttaattctttattgactggatccacggtaatttctttttgtgcataggcaatttcaagtccaagatcattttcaaagtaatcatagatcgagtcttgtgctcgacgttcaggcaattcttcaataatcgaagcatctaaataatctttatctagaatgacaacttcaccatcaatctttctttgacgtaccaatttccaagcttcagaagcaactggccaatcagtaataccatgtaattttggtgaaacggcgatcttacgaatttcaactacttttgtttcactaggaatacgttgagtatcttgtaattctttaaaactagttagaccagaaataggaaagtcaaaacgattcagatctaaaacgattgaaccttttccttgttttttttgaatgtagccagcattttttaaaagattcaaggcttttcgaaccgtttcacgagaaacactgtacattttgattaattggttctcactaggtaaaagagagtgtggcgggtattcgtttgacagtatcttttgttcaagatccaaaaatatctctttgaatttattcatgggattgcctcctcttgcctattatagcgagggcatttttgaaaagcaatcggctatttggccaataattcatcaattgaaagatccgtcagtttttcgacgattgtgtcagctccatgcagttcttcaccagaatagacaccaactgcatacatgccagctgccttaatgccatcaatacctgcttgggcatcttcaaaaccaactgcatcactaggtttaatgttcagcccttttgcagcttggataaagatttctggatctggtttacctttagaaagtgtggctgggtcaacgattacatcaaaatcctgcatgacacccaatttatctaaaataaatggcgcatttttagatgccgatgcgatagcacaaggaatccccttgtgttttgcttcttctagaaaagttttgacacccggaagaaggtcatccggagtcagactttgaagtaattgaacatagtgagtgttttttttgcttgctaaagcatctttttcttctgaactataagcatcatttttatttcctaatgttaaaatacgctctaaggaatccatacgactaatcccttttagttgttcgttgaattttaagtcgatttcaataccgatttcagcggctagttctttccatgcgatatagtgatatttggctgtgtctgtaatcacaccatctaaatcaaaaacaaacccttttttcattatgttactctcctttaatagttgatagattgttctttattggcttttaattcatgagtagcaccagaaagaatgatcgttgtattttggtcagctacaactgtcaatgtttcatgtgtaacattaaagtgataattaatacctctgacttgaatattaaattgaatattttgccattgcttaggcagatttggatcaatacgcatcacatcttcccgaaaatcgattcccgcaaatgtcgttagcggaatatagagagttgccgccattacacccgcatgaattccttcggcagtggttcctccttgaatatcgcggtaatctgaatagagagcctcttgatataaagaccaagcgagatcttgctggtcaaccattgctgccaattgagcatgtacaactcgagagagtgtagagccatgagaagttcttgccaaataataatgcaagtttttttctacataatcttcgggtaagcggtaagtaagatcatctaaaatttgatgcacttgcgctgttgaaaaattgtaaaaaatcattaggctgtcagcttgtttggcaactttgtatgcatcggcgctttttccttcagcatttaaaatacgatccatacgataaatgttcccatatttttctctataatgatcccagtctaagtcttttaaatcaaaatagccttcaaattgtgcaataattccttcgggattaatttctaaacataaatttttacgaatatcggtcatttgtgagaaattgtcctctgaaagctgcactttagctgctacactttgaaagatttctggtgaaagttggttgcgtaatttttccacttcttcaaacaaccacactaccatcatattagtatatgcattatttttcaacccacctttttgactgttgggatagctttcatgaaattcatccggtcccatgacaccttcgattgagtaacggcctgtgagagaatccaaagtagcagcactctgccaaaaatgagcaatttctaaaattaattctaaaccgtattgctccataaaagatcggtcacgaacgttatgccagtactgccatacattataggcaatcgctaaagaaacgtgacgttgcaatcggctatggtcttctttccactcaccactgataggattcaaatgaagttcttgtgactgttctgttccatctaaaccagattgccatggaaacattgctccttggtatccggcttctttggctgctttcttggctgccgttaagcgctgatagcggtaaagtaagatctctctggcggttttaggaaaatgaagaatataaaaaggtaagatgaataattcatcccaaaaaatatgaccacggtaagcctcaccatggagaccacgggctgtgatactagcatcaagagattgctcataggcgttgggtgctgctgacactaatagatggtatgtgtgaagattcagcattttttgtgacatgagatccccatcaatggtaatggctgcattctcccatagtttgcgccaagcttctttggattcagcatacatttctttaaaccgtggtagtgaaagaagtgccagcttgctagtagttgtttgttctcccatttgatatttagcaacagtaactgatttttctaaagtataagttctatttttctccacagaaattgttaatttttgaattactttttctgccgttttttctgattttaatgtttcaagagaaaagtcatcagaaaataattgtgatgcttggcaaaccgtaatgtcagactgatttgtacgggcaatgagtagagctttgctcttaaaatactccgttgtttgaatggtcaagtgcttgtttgtcaagcttcgatagcgtgcgacattataattgtagaccgaaccatctgcttcacttatcacgtcgatttctccggtaaaattaagtggagtaaagcggtaaaggatggagtagtgatgactatttcccatattagcaattttttgtgtttcaattcttaattgcttttttgtgtgtgtttcgatttcagcgaaggaggtaaataatccagtttttaaatttaattgacgcttaaaagataaaagtgtattttgtgcgatatcgattttttcgttatcaatgactaaataaattttttgcagatttggtgcattgacgaagtcctcatttgtaatggtacgatcagacacctctgactccgccgtattatagagacttgctaaataaatcccaggataattggcatcggaaatctccatttctggtgtagtaccacgcaaccctataaagccatttcctactgttaatagtgattcaacggagtactcatctttgccaggagtatagccataatattctaattgccaaggaatctccaaacgcttctcttcaaagctttcttcagttccacatacaaacgctcgatttaatttttcggttaaccattgatctaatgaaaaggttccttcttcgttagtaaagacgaatgagtcggaaaggattcctccctcttgattcttttccaattgtttctttaatgctgctattcgttcattggtggtccctgtaaacgtgaatatagcacccatgtggtcggccaatagccattgatcattagtgatctcaattttgttcacagtattctctcctttctacttgtctatacatgcaaaatgattataaccgatattgtaagctttttcaatttaataaggctgtttttttaaattattgtgtaaagttaaatgaaagtgatttgttttttttatttgctcaaagtttatttttttgaatgaaaatccttttgtaccaacaaaaataaagcatgttctgaatgattatttttcacaaatgtctttagtgaaaaaaatatagaatgaaacgcttgcaatattgtaaatataaagttatgattagcatgaaataaaaacatatatatacaagtttaaatggaaggggtttattattatggggaagtatcgggatgatgctgagaaattgctggagtatgtaggcggtaaagaaaatattgcagctgtgactcactgtgcgacgcggatgcgatttgtactgaatgatcagtcgaaagcaaacgagaaagccattgaagatattccaagtgttaaagggatgtttacaaatgctgggcagtttcaagtgattatcggaaatgatgttccaacgttttacaatgattttacagcggtatctgggattgaaggagtttctaaagaacaaagtaaagcgattgcaaaaaagaatcaaaatccgtttcaacgggctattgcagttttggcagagatttttacaccaattataccagctattattgttggaggacttattctggggttccgtaatgttttggaaggaattgattttggtagtggaacaattgtttcccaatctgtattttggagtggagttaatgatttcttatggctacctggggaagcaattttccattttcttccagtaggtatcacatggagtattactcgtaagatgggaacaactcaaattcttggtattattttagggattacattagtctctccacagttgttaaatgcttattctgttgctagtacagcagctgctgatattccattttgggattttggatttgcacaaattgataaaattggttaccaagcacaagttataccagcgatgttggctggttttatgttagcatatttagaaatcttttttaggaagcatataccagaagcgatttcaatgatttttgttccgttattctctttattaccaacaattttagctgcacatgttgttttaggaccgattggctggtggttaggagacattatttctaacgttgttaatacaggcttgacttcttccgtcagctggttgtttagtctgatttttggagccctgtatgcaccattagttattactggacttcatcatatgacaaatgcaatcgatatgcagttgatttcatcatttggtacgacaaatttatggccgatgattgcgctatctaatattgcacaaggttctgctgtattagcgattgtatttttacatcgagggaatgaaaaagaagaacaggtttcaattccagcaacaatctcttgttacttgggagtgacagaacctgcaatgtttgggatcaacttaaaatatgtttatccatttgtagctgcaatgattggttcaggtattgcaagtatgtttaataatttaatgggtgtgcgagcaaatgcaataggagtcggtggattacctggtattttagccatcaacgcaacagaaggcggaggtttgttagcttttgggatggcaatgctgattgcaatagttgtaccgtttattttaaccatagtttttcgccgtcaaggaatctttaataaaattgattcagtcaatagtgttgaagacaatgcgtatgcagaaggactggcaacagcaggtgcaagtgctggtgtagcaaacactccatctcaaactatttcaaaagagactactgtaactgaggaaatgctttatgcaccggcagatggtcaaatcattgcaatcggtgaagtggaagaccctgttttttcacaaaaaatgatgggtgatggctatgcagttcgtccaagtaacggaaaaatctatgctcctgttgcagggacggtttcaagtatttttgaaacaaaacatgcaattggaattttgactcctggtggggcagaggtcttagttcatatgggattagataccgttgaattaaaaggcgcaccattcactgtcaaagtgtcggaaggtgatgctgtcacagtagatacattgattgctgagatggatctagaagctgttaccaaagctggaaagaaaacagatgttgttacggttcttacgaacgctgaaaagatcaatcagctgacaatcaacaaaaccggcagtgtacacgcgcatgatcgagtaggggctgctgaagtccgctaaataaaaaagagtaggctcatgaaaggaagctatcattccattcatgagccgtatttttttgttttatttttcttaaagggttattttgtttggcgtacacgttctttataaaagtagcgcaaagttagaaatacgactagcaatactagcacccataggaagaataaagcgatttgtgaccctaaaattgttccggaaatataatcgggacttactttttgagcaaggtcgatcattgtcgcaactaaagctgttgcgacagcgccagaaaattgttgcagtgtgttgaagacggcatttccatcggcggccaaatgttggtcaattttacttaaccccatagtcatcatattgctatacgaacaaccgattccgatcatataaaagacatgggcagcaataaacgcccacaaaaacgtcaggtgcaatagcaaggccaacgctaaccagccaaaagtaatcaatacaagaccaatcataatcggttttttaggtccgatgctatccaacatacggcctgaaagaggagctagaacagcacctacaatcgcaccaggcaacataaccaatccagcagtgaatgcgtcctgaccaaggactatttgaacaaagtttggcaagacaaatgagattccaagtaaaagaaactgacagacaagaaatccgaataagaataatcggaaagaacgatttttgaatacagataagcgaatcaaaggctcagattgcaaggaacgtttatagaaaagagctgcacctaaaataccaagtgctaatggaaatatgctcgtaagagaaccaatttggtttaagaaaagcaaaaagccactaaacataaaagtgatacccaaaacactccacaaatccagacgaccagttttttcaattgcaattttaggtattgaataaagacctaaaaccaatgagaccaataagacgggtattaagaagaggaaaatgtagttccaattcaagagagaagtcaataaacctccgtaagtaggaccaatcgccggtgcaattgaagtagttaaatttccgattccaatcatagttcctcttttttccaaaggagagtacgtaaggatgatatgaaacatcaacggtaaagcaattcctgtacttgccccttgaagtaaacgaccaagtaataggatagcaaaggaaggggagaggaaatcaatcagtaatcctgctaaaaacaacccgttagcagccaaaaataatgttcgaatttgaaattgtttcaacagaaaagtagaaattggtacgatgatcgatatcaccagcaaatagattgttgtaacccattgcacatttgaagtagaaagattgaattgattaatcaaagtcggaaatgttacattcatagctgtttcgatcaataccccagcaaatgacataataccggttgctataatagcgcctaacaattttatttttttctccatattatcacctctaaaaaaattcataaaaaaagagccagtttctaaataaatagaaaccgcctctctctcgacaagcattactgcttgttatctgtacgatttaatctaaaagctattgtactgacttctttttgaagagtcaatagaaatgtttgaaaaataaaactgaattttatttgaaacttttcaaaaaaatccttacaccaaaatttttattttgttagaataatcaagtatgtaaaaaaaaaaggaagttttaaatgccgattaacaaaaaagaaagtttgatctatacgacatttatgtgtttttttatggtgtacttcatgagtgtctacaatttaatgtatgaggtgggaattactgcaatagcttttcaattggcttggaatgaactgccatttgctatatgtattgcgtttattttagattggtttattgtctcaggtcctgcgaaagcatttgctttccgttttattgaaaaagataccccagcttggaaaaagattggtctaatctcatcaatgatgattgctggcatggttttctttatgtcactttttggtgctgtaatgcatccgaatgtaaatcaaggactattaatgacatggttatctaatattggtaagaatgtagttgttgctttaccgttacaattattgattgccggaccaattgtacgacgattatttagaaaattatttcccataggtacggtacaagaaattcaatagaatttatacaaagggccacttctgaggttgaactcagaagtgactttttatctaaatatatttgttaaataacaaacaaaaaacaccataggatggtatggcgtttcttgtttaccctataaaataggatacaggatgtacttacataatagtatgcataggaagaaaagtatagttcaacaatttcattgctcggtgaaatcattgctttgaacatattttaatctgtaaaaaaattgaaaagttggtaccaaggacggtcagatacgatgtatgcttcaggagaaaaccctgatgatgcataccctaaaaaacaaatgaatagccctagaaaaatgaatgccccgcctatcattagtagcaaacgtttatttattttgatcatcttaccacctgcttttgaaagtttttgtataacgctttaggcaaatgaataaactgttgcgtccaacctaagatgggtttactaagcatataagtaaaaatcatacatactaaccctattccgaacatcgtgacgcctagacctagctgggtgatagaaaagtgaagaccttgagatagtagtaaagggcttaaaacaacacttgcaatgccgccaatcagtgaagttatgccaataacacttgtactgaatggaaggcaccaaataactatcaaaccactaagcatcaacaatagaacggttaacagtaagcttccccacagaggaaatcctagaaaaattatcactaataagaatggatgaaaacgccgaggaacttttacgacaatttcttcggcacctaatgcactttgagcaatactttgaggagtccctaatctggctacagcttcaacttcagagagtccctcttccatcaaatcttggatcatttcatcataataatcaataagatgatgaatctcacttggtttggtcttataggctaattcagctgctaaacttttaataaatgttatgcgatccatgtcagttgtctcctttaatataatgatgaattttttctaaatgaggccaatcaatagtcaaaaatttatggatactattttgaccatgagcagtgatttgataatattttctcagccggccattatgttcttttgaataagtcgaaacttttttatttgcctctaagcgtttcaagatagggtataaagttgattcagagattggcaatagaggagcaatatttttaacgatttcatatccataagagtctcctctttgtaaaaaagctaacacacagaattcgataatcccttttttcagttgactatccaatgactacaccaccttatacataatactatataaaacatagtatagttttgcaagtcgatttgtggaaatcagtctcaagacgtagtaacttccaggttgcgcctattttttttgcttccagtcatttttccttacttaaaattcatcgtacggtgaaaatattgattattttatattagattcttttggtaaagtattactaataaaaagttgttaggattttagacaaacgtatagttgttgtgttaggtaattgctgttggaaaagttgcttgataaaagacacacgatactcagtccagctacgaaagaagttagtaagagagtgtgtgtttatcaggaaaggagttaataatgagaaaacaaacaatcacaaagaaatatttaatcaataggttacgcagtcatttagaagaatatttgtatactcccatcactgttagaaaaattgcgaaatatgcaaagatttctacacaaccgatctatttgcaattttcgaatatgcaaaattataaacaggcaatgattgatgatgttttggcagagattcacgagctttctttgaaaaaggagatagaggatgatccattgtatacgttttggcttaactattatttgtttgccagccaaaataggaacttattttttgcgttatttttgaatgatatagggtgtggttcctatttaagagatcaatcattgtcattgtttatagagacaatggctgaatccgaagtatatcaaaaagcaaattgcgaagacattgaaaaattgcataatgaaagtttgattttcttttctggtctcgttcttacttatgtacggggagagaatatgcaagcaatagaagaatttttacaagatattaaagactatttttatcgtacactgattgatcctatgtatatttatcgagaaatattaccacaatcagtcatcgaagctggtttttaaaataacgataaactgttttttaatttttttcattacttgataggcttcttgctttataaaaattcttggctcattcattttcttgtaaacgaatagtatgggtttattgttggcaattttcaagaaatatgagaaggtagaattagcaaaaagtaaggtgttttatgactaaaaagaaacaagtgatggaggaatcttgatgggtcaaacagataattattcagataaaaaagctcaaatcgatcagcgaatctgttttttggaagagcatacttaccaaggaaacgaccttggcgtaacctttcaagagcatgcgataacctttaaatgctggacgccagaggctgatgcagtttcagtcattatttatcaaagcggagaggttaaagacaaggatcgtgtgatgacagttccaatgaagcaagaaaataattgttggaaggtcacagttacggatgaagtcaaagaaatgttctatacgtttgaaatccagcgaggacaagagaaggttgaagtggttgatctttatgcgaaagctgtcggtctcaatggggatcgtggggctatcgttgatttaaaagaaacggatcctgagggatggtcgcagacagaatgtgttggccaagatacgattacagacgcttacatttgggaattacatgtggaagatttcagtagttctaaaactagcggcatctcagaaaaaaatcgtggaaaatatctagcgtttactgaaaagaatacgcatcttgaaggagatgaaaggcagccaacagggctcgcctatttgaaagagcaggggattaactatgttcatctgttgccaatctttgattttgataatgacgagctgtctacagcctacaactggggatatgatcctaagaattataacgttccggaaggaaagtattcttcagacccgaaggatcccaaagcccgcattcgggaatgcaaacaaatgattcagtctctccatgaggaatctattggtgtagtaatggacgtcgtttttaatcatactgcagtcacagaatcttcttggtttaataagactgtgccaaactattactaccgtaaggatgaagaaggaaatttcgctgatggctctgcctgtggcaacgaaattgcctcagaacgtaaaatgatgcgcaagtttattattgattcaatcctttattgggctaaggagtacaaaattgatggatttcgttttgatttgatgggactgatcgatgtggagacgatgaatcaactgcgtgcaagcctggattcggaaggtttctctcatgttattctatacggagaaccatgggatgccggcagcaatcgtatcatccagccaaacatcccagcgaataaaagtaatgtctgggcactgtcagaaggcgttgcggtttttagcaatgatttaagagacagtatcaaaggtgatgtctttgaagaaacagacggagcttttattcaaggaatgaatggtcaaccgcaagtcaagcaaaccttttatgcggcaaatttggcaacggcgattcaaggaaatacgaaagttgctgaacaagaaggcgccgagcgctgggcaaaatctccccgccaagtgatcgcctatgcttcagtccatgataatttgaccttatgggacaaactggtggcaaccatgcaggcttcagcgaaggaaagaaattatgattttgatcctgagcttttagcccgcaacaaactagcagcagccattttgtttactagccaaggagcagtattgacccaagcaggcgaagagtttggccgtaccaaacaaggagacgaaaattctttccgttcaccgatagaaattaatcagctagactggaaacgcgcacaaacttttaatgagttgcggtcattttatcaaggtatgtggcagatccgtaaattctatcctccattgagagatgccacgattcgaacagctgaaagtattcagtttattgagagtaacaatgaaaatttccttgcatatattattccgaataatggttacaatgatacatggcaatcattagctgttttggtgaacagcagcaataaagacattttggtaaatagggaagaattcaagcaagagaaatggtggatcgttgcagataattttggagcaggtatagagccacgtggagagatcgtgaaggaaatcaacatcgctgccaaaagtcttttacttttagctaaatagttattttatttttaaaatttttaaattaagaagaaagttaaattgtattaaaatccatatttaatggattttaatacaaccattacgaatgtttataaagtgataggaataattttctgttatgagagaagtacaggtggaccataacatgaacagtttaaaagaaaccgattttatgatgacaatctgactgcttaatgctatagtaaaaacagaaaaaccaaagttggattgttactgactcgatcaggcaaaacctaaatgagaaaacgctctttgtagcggctcttatttaggttttttatttttttcgggtatttcttagaatgttaagcagcaaagttattgtttcagttacttgcaaacatatgactttgttaaaataaattaggcaaaggagaacgagcaaatggcaaaatttccagaaaatttcttatggggcggcgcgaccgcagcgaatcaattagaaggggcgttcgatcgcgatggcaaaggcttgtcagtggcggatgcaatgcctggtggcaaacagcgtttagcgattttaggcagtgatacgtttgattggacgatcgatgaggacaaatacacctatccaaatcatcgcgggatcgaccattatgaccgtttcaaagaagacattgcgttgtttgcggaaatgggcttcaagagctatcgtttttcaatcgcttggacacgtatttttccaaaaggtgatgaaacgacaccgaacgaagctgggttagcattttacgatgcgttgattgatgaatgtttgaaatacgggatcgagccagtggttacgatctcccactatgaaatgcccttgcatttagccaaagaatacggtggctggaaaaatcgagcattgatcgatttctatgagcgttttgcaaaagtcgttttggaacgtttccatagtaaagtcagatactggatgactttcaatgaaatcaattcagctttccatttctccgcattgagccaaggaatggtcaacagtacgggtgctagcgactttacaaacgtgatccaagcgtggcacaaccaatttgttgccagcagtaaagcagtaaaaattgggcatgaattgaatcctgagttacaaattggttgcatgatcatttatgcaacgacctatagcattgatgcaaacccagtcaaccaagtagcaacaatgacccataaccaagccttcaactactactgtgccgacgtgcaagtacgtgggaaatatccagcatttactgatcgcttgtataaagagcatggggtcaagaaggaagatcttgatattaccgaagaagatttagtattgattgctaagtataccgtcgattatattggatttagctattacatgtcttctgcagtggatatcacaacagaagaagctgatgaagtacaaggtaacttgttgggtggtgtccgcaatccattcttggaagcaagtgaatggggctggcaaatcgatccagaaggactgcgcattgcgttgaatgaattgtatgatcggtaccagaaaccattatttatcgtggaaaatggtttaggagctatcgatactattagtgaagatggcaaaatcgaagacgattaccgcattgattacttacgtcgtcatatcgaagcaatgggtgaagcgattgaagatggtgttgacctgatgggatatacaccatggggatgtattgacctcgttagcgcgtcaaccggagaaatgagcaaacgctatggctttatctacgtggactttgatgatgaaggcaatggcacaatggatcgatcaaagaaaaaatccttcgattggtataaacaagtgattgcttcaaatggagaagatttagcgtaagattaatactcgtttttttatagccgcacaacacggattatcgttgtgcggttattttgctgaaaaaatagattgtctgaatagagtaaaaaatctaaaaataatagataacacatcataaaaattttaatcagaaaaactttaataattgcacttggtaagcggaataaaactaaattttctaagaatggctgactctttctttccaactaaaaggggaccaacatatttttgatgatatggaaaattttgcaaatttagaagggcgttgtggttttcttctgaaatgtttcacgtgaagcatttttacagaagatagttacatcaaatgcaatattttcgaaaatagcgactctattttgtgaagcggatgagtttctcttagaacgtttggattaataaaaattatttcgagccgattaaagaagtaagagaacggagtaggaaaaattgtttcccctcatctattcgaataattggtctttaccatatgatggtgataagattaaaacatagaaatgtagagcattttgtttgtgaaaacgtttcaattttaaagaatggagagtaagcgattaaaaaataaaaatagtaggcaagttacttcttttttacttaagagaggagtatattcgtatttggaatttttctttatttagaatgattttaatgtatttttttagaaatagggggatgtaaaatggatattgtaacattagcacgaatccagttcgcgatgacgacgatttttcactttttctttgtaccgttttcgatcggaactggtgtcgttgttgcaatcatggagacactttatgtgatcaaaaaagatgaaaaatatcgccgaatgacaaagttctggggaaatatttttctattaagttttgtggtaggagtggtaactgggatcattcaagaatttcaatttggaatgaactggtctgattattctcgttttgttggggatatttttggtgctcctttggcgttagaagcattgctagccttctttttggaatcaactttcttagggttgtggattttcacatgggataaagtcagccctaaactgcatatgacgttcttttggttagttactattggctcgatgctctctgctttctggattttagctgccaatagttttatgcaacatccagttggatacacattgaacaatggtcgtgctgagatgactgacttcggagccctgctagctaacccacaagtctggtatgagttccttcatgttattactgcagcaattgccatgggaggaattctgattgcaggaatgtcagctttccaattgttgaaaaaagacaagaaagttgaccgtgattttttcaaaaaatcaatgcggatcggttttgcagtagctttgtttggttcaattacggtgttgatcgcaggtgacgaacaaatgaagtatttggttgaagaacaaccaatgaaatttgcagcaatggaaggtacgtatgaagataccggagatcctgcggcatggactgtagttgcatgggcaaatgaacgagaacacaaacgggtttttggtgttgagattccttatatgttgagtatccttgcatttaacgaaccatctggttcgattgacggaatgaacacagtgaatcaagatttgatcgaacgttacggagatcggaactattttcctccggtcaacacattgttttggagcttccggatcatggcaggtttcggtgcattgatgttgttggtttcttcattggggttattctttacgcgtaagaagaagccttcgctatttgagaaacgttggatgctttgggtagtggctataacattatttaccccattcattgcaaatacagcagggtggctgattacggaattgggtcgctatccatggacagtctatggtttatttacgattgaagatagtgtttcgccaaatgtatcggcaacttcgcttgttatctcaaatattgtttactttgttcttttctctggtttggcattaacaatggtttatttgattcggcgagagttaggacatggtcctgaaaacaaccagatggaaggaacgctgcacgaagcagaagaagatccatttgataaggaggcgtttgaaggatgaccggattgcaactaatgtggtatgtattgattggcattttgtttgccggcttcttctttttagaaggatttgactttggtgtggggatgtctgtccagacattgacccataatgaacaggaaaaagatcagatcgtgcatacgatcggaccagtgtgggacgggaatgaagtttggttgattaccgcaggtggcgcgatgtttgcttctttcccttactggtatgcctctttgttcagtggttattatttgattttgttattgatactagtcggattgattatacgcggtgtctcctttgagtttcgggcaaaaatgcctgaagaccgtaaaaatatgtggaattggacattaaccattggcagtacattggtgccttttatgttcggactcttgtttacaagtatggtccaaggcatgccaattgatgcagagggaaatatgtctgcgcacttcggtgactacgtcaatctcttctctgtagttggcgggattgccttaactttgctttgctacttacatggattgaattatattgcactaaaaactactggtccgatccgtgaccgtgcccgaaattatgcgagtgccttttatggtgtgctatattttggtttggtggcgtttgccgcgctactttatttcaaaacagatttctttgaaaaacattttgcttcgacgcttcttttgctgattgtgattgtggctttgacgctgatagcgaatatctctgtatttaaagggaaagaaatggtggcatttattgctagtggtttgaccatggtggcgctagtcggattgttgttctctggtttgttcccacgagtattgatcagctcaatcgaccctagttatgatttgttgattgcagaagcttcctctagtcactacacattgaagatcatgagttatttatcactgacaatcttgccgtttgttttggcttatacagcatggacctactatattttccgtaaacgaattagtcatactgagctgacggagggttattaatgatcgacaaacaaatcatagagcttcccggaatgaaacggttaatgggattgcttgcaggactttctttcctgcaagctctcttcatcattggacaagcctatggtcttgctagtgggatcactggattatgggaaggacaatcgttagaagagcagtggggctggattctactgttcttttgttcgtttttaggtcgccaggccattgtttattttcggacaaagaaattagacagctatagttaccagcaagctactgaattacgtaatcaactgctagaaaagatttttcgtgtaggaccacaaatcgttcagcaacaaggtaccggaaacattacaacgatggtattggaaggcattagtcaggtagaaaactatttacaacttattttggcaaaaattatgaacatgtcgatcattccttgggtgattttggctttagtattttacttggattggatctcaggtctggttttattgctggtttttccactgatcattatttttatgatcatcctaggctatgccgcccaaagtaaagctgaaaaacaataccgcacatttcaattattgtccaaccactttattgattcattacgtggaatcgacaccttgaaactttttgggatcagcaaaaaatatggaaaaagtatcttcgcttctagcgaacgttttcgtaaagcaacgatggggtcgttgagagtcggaattctttccacttttgcattggattttttcacaacattgtccatcgctgtggttgcggttttactggggctgcgtttgatcaatgaagaaatcttgttatttccagcactaacgattttgattttatctccggagtattttttaccaattcgcgatttttcaagtgattaccatgcgactttagatgggaaaaatgcaatgaccgctgtatctacgattttatctgagccagaagcagccattgatccagtaagtttacctcaatggcaagctgattcgcaactatcgattcattcgttatcttttgattatggagaaaagtctgttttgaaagatattgcattggaggtccaaggatttcaaaaaattgggatcattgggatgagtggctctggaaaatcaacgctgatcaataacttaagcggctttttgattccgaaagaaggcgaaattacttttgatggccaaaaaatgactgcattaagacagtcggattggcagcagcaactagtttatattccccaaaacccctatatctatcggatgactttgcgagaaaatgtggctttctatcagccaaatgctactgaagaacaagtgtggcaagcaatcgaagttgcaggtttaacgaaattagttcaagaattgccgcaaggaatcgatacaatgctaggtgaaggagaacgccatctaagcggtggacaggcgcaacgaattgcgttggctcgtgctttcttagaccagcatcgaaaaattttattatttgatgagccaactgcccatttagatattgaaacagaagtagaattgaaagaacggatgcttccgttgatggagaaccatctagtcttctttgcgacacatcgcttgcactggatggaagagatggatcaaatcctagtaatggatcaaggcagaattgttgagcgggggacattggcagaactgcaagcaaagaatggcgctttcgttgcgttagtcaatgggatgaggagggaacaacttgaataaaatcggtctctggcgttcgctaaaaacagatacctgggtcaaaccctttctttcaaagtacaaaaaggttcttgcagcagcgctgtttttaggatttatgacattcttttgcggaggcgcgttaatgtttaattctggctatctgattagccgctctgcctcaattccagagaatattttgttagtatacattccaatcgttctgacccgagcattcgggatcggccgaccagtttttcgttatgttgaacgactgacaagtcataattgggtgttgcgaatgacatcgaacctacgcctaaaactatacaatgttgtcgaaaaagatgccgttttctttaagcagacccatcgaactggcgatattttaggattattagcagaagatatcaaccatatccaaaacttatatctgcgaacgattttccctacggtgattgcttggttattgtatacttttctgattatcggattagggtacttttcgttaggatttgcattggtaatgttgctgttgttgggaataaatgtgtttgtgctgccgctctggtccgttgtgatcaatggcgctcgtcaagaaaagcaaaaacaaatgaagaatcaattatatacaacattgactgataatgtgctaggagtttctgactgggtattttcacagcgaggagcagaatacgtcgatgaacacaagcaattggcggcaaatctacgaagcgttgatgagaaaatcaatcgttttgatcgaaaaagagatttccttttacaagtgatcttcggggtgattacggttgcgttgattgtctggacaagtcagcgatttcctggcgagcacggtggcttagctaattggatagcagcatttgtcctttgtgtctttcctttggtagatgctttcgcaccattaccttcagcggcacaagaaaccaatatatacaaagattcgattgatcgttttaatgcattaccagaaaaagaggaacaaaaacggacagcatcagctataagtgcaccgttcaatttagaagtgaatcaggttagtttccattatccatctgaaaaagaggtactaaagaatcttagcttaacgattcctgcgcatcaaaaactggcaatattgggacgtagcggttctgggaaaagtacctttgcttctttgctcaggggagatttattgccgacccaaggtagtattaccttaaatggtgagccggtagcaagttttggtgaagatattagcgaatggattggagtcatcaaccagagtccttatttgttccatacaacgattttaaataatttgcggattggtaatgaagaagcgtcagaagaagaagtttgggacgtactgaaacgagtaggcttatcagagatggtgacagctctgccagaaggtttgcgaaccatggttgatgaagcagggttacgtttttccggcggtgaacgccatcggttggcattagcgcgaattcttttgaagaaaacaccgattattttattagacgagccaactgttgggctagatccaatcactgagcaagctgttttggaaacttttttcaatgagttggaagacaagacgattatttggatcacccaccacctgcaaggaatctcactgatggatcaggtcatttttattgaggatggagaattaacgatgagcggtacgcctgctgagttagctgtcgaaaaccaacactttcaacagttattagctattgatcaagggcgactgtaatcaaactgggacctttgccaagacaacaaaaaaatcggctagtgatcgacatgaatgtcggcttagtttttgaggagcattcgctcctcaaaacacttcactgtttacccgattggttcgtttattttcagaatagctttcagttgcggagggtagaataaagaatgatcaataatttcgttgcaaaagcagttgcgttagctcgcgaattttttctttgctaggggtgttcggcagcagttcgatgtcggctagtgctttttcggtataagaaacagcaaaatcggtggctttttcgacgccatgataacggcgcactaattcagcaacctctgtggcctcctcggtggtcaactcgctttttttggacagatagctctcaaatgcggcaggattttgttctttagcaaagagcagaggtaatgtatagacaccttgtgccaagtcttcaagaacgggttttttcaacgttccagaatctgctgtatagtccaaaatatcatcaaaaacttgaaaagcgatgccgatgtttcgtccgatctcaccagcccgttcttggttttctaagtcgagaccgccaaaatgagcaccttcgatgcaggccagccagaataattcggcagttttaccattgatgctttgtaagtaatcagcaattgattcatctatattgtagcgtgtgtgcatttgatctaattctcccagcaaaaggcgtttcattgcttgggcatttgtagccaaaaaatgagagccattcatgctctcgatcaataactcaaagaattgggtgaagagcaggtcacctgtgtaaacagcgatatctttgccatattttgcttggacagtgatgcgtccgcgacgcaacggcgaatcatcaatgatgtcatcgtgaatcaaggttgccatatgtaagatttctaatgaagcagcaattttggttaattgatcatttctttcatcaatgggttcgcctagatcagcgaataagaaaaataatgctggacgcagcatttttcctccagaataagtaaaatcaactaatacatcttgtatttctttgttacgaacagttacgcgttcttcaatgatcgaacagacagtttttagtctttgctcgatcgaaggataatcgatccaaaaattcaacatattaaaaccctttctaccagtcattcagcccttattctaacttaaagggagtctattgactagttaagtgcatttatcaaaaggagatgagtatttgacactcccagtatttctggagcttgtggaatttaaagcgaaaacagccagtgtcctcccattttttatcggaatttgttacagctggtataactacggctcaattcatttaggttatgtggtgttatactttattgctatgctgatcttcaacatggcagtagatattttagataattataacgattaccatcacgcaacagaagttcatgattacaaagaaaaaacaaatattatcggacgcgagcagctctcgcttccattcgtttttcgcttaatgatcggtatgatcgtcgtttcggcggtgatgggtatcgtattggcctatttcgtcggttggcccttgttttggatgggactttattgttacttgattggtatcttttactcatcaggtccgcggcctttatcgagtttaccgctaggtgagtttttttcaggatttacgatgggcttcatgatttcgttgatttgtgtatatttgaatacttatgaaacctttcaatggaatagcgcgaccttgggtggaatatttctaatcgcactacccaatacactgtggatcgctaacttgatgctggccaacaacatttgtgatttggaggaagatgaaaacaacaatcgttatacattggtgcattatttaggaaagagtcaaggattacggctatttgttcttttgaacattattgcatttgtagcgatcttgacagcagtggttctgcatttagcaccatggacgatgttgttgacgtttctcgtcttaccatttgtctggaaacagacaaaactatttatgcataaacaaatcaaacgcgaaacctttgtctgcgctgtaaagatccttgcggtcggagcatgtgcgcaggtcattagttttgcgatcggtttgattttataattttttgaaggaagaaaggaagtaataggaaatgaaggaagttgtcattttaggagcaggctacgcagggttgcgagcattgcatgtattacaaggatcaaaaggtgattttcatattacattagtagataagaatgactaccattatgaagcgacagatttgcatgaagtggctgctggaacgcagccaagagagcgaattagttacgatatcgctgatgtggtacgaccacaaaaaacaactttcctacaaaatgaagttgcaacgattgaccgtcaaagtcaacggatcatgtttacggatcaaacatctctttcctatgattatttgatcgtagcattaggatttgaatctgagtcatttgggatcccaggtgttaatgaaaacgcattggaaatggtagatgttgattcagcagaaactatttatcatcatttattgaaacaaatgaaagaatacaaaaaaacacaagatccagatttattgaaaatcgtcgtatgtggggcgggattcactggagtagaactcttaggttctttagtggaaaatcggaaggaatttgctgagatcgcaggtgtccaatcagaagaaatcaaactcttttgtgtagaagcagttacgcgattattaccgatgtttgatgaaaatctgtctgcctatggaatcaataacttggtaaaatggggtgttgaatttctaacaggaaaaccaatcaaagaaatcaagcctggagtagttgtttatcaaacggatgctgaaacgggtgctacagaagaattgtctgctaaaacgatcatttggacaacaggtgtcagtggaagccatgtcatggcagattcaaattatgcggctcgccgtggacgtgtgatggtcaaccaagatttaagtgatccagagcacagtaatgtttttgtagtaggggatgtttcagctgtgatggatcctgcaacaaatcgcccttatccaacgacagcacagattgctttgaaaatggggtatcaatctgccaaaaactgtctacacttgattaaaggtgaaaaaacggaagactttcattttgaatctttaggatctgtagcctctattgggaacacgcatgcctttggtttggtgggtaaaatgcctgtaaaaggttatccagcatcatttgtcaaaaaagccatcatggaccgctccctgttcctaactggtggggttaaagaagtgttagcaaaaggccgctttgatttttatcattgagtcgtgcgctattttttcaacttaacattaacagaagcaagaagagaacatgtaccgatggagatagtttaattataagtaaaatagacagagatgccgattcatgttgggtgtttctgtctatttactactatttcagtttttaacaccatagggcgtaaggcctttattgaatctctagataaatgatcaggttttgaagagaaaacagggtaagaaaaaacccccttttgtacctttattaaaaaaatgttaaaataaagagactatgtttgttgggaggcatgaaatgacgattcgtaaagaaagacgccgtttagaaaaacgattgaagcgttcattattagcaaaaaaagggttgacgatggctacaactgtggtagccggttcaacgattgcaccaaatttggttttagctgcagaaacagcgacttcagatgatgcaaaaaaccaagcagagatcacagaaaatcaagtatctggaggaaatagctccactgattcaactggagacagcattcaaagcagtgctgacgagacgatttcgacagaggaaacaacagaaccaactgttcctattgaagagcagcctgttacaacacctgaggaagcggcaacgccacaggaaactatcacggaagatacagcggtcgttgagacgccaattgttgctgcacctgcgttagcaagaacctcgatcttctcagcacgtgctgatacgagtggatttattgcgaaagcaagtggttatgcaacagaagtagctgccgctaatgatctctatgcatcagtgatgattgcacaagctatcctagaatccggctggggtacttcgactttgacgacccaagcgaacaatatgtttggaatcaaaggaagttataatgggcagtatgtcgaaatggcaacattggaagataatggttcgggcaattattatcaaattatagcgaagttccgcaaatatccatctttaagagaatctttccaagataatgcgtatgtcttacgaaataccagttttgctgccggtagctattattacagcggtgcttggaagagcaatacgagatcatatacagaagcaacggcatggctgcaaggacgctatgcgactgatacttcctatgccagcaaattgaacaatcttattgcaacgtataacttaactcaatacgatagcggcagttccgctgggaacggtgacatgaataatgttgagacccctgtaggagaaaacgcgattcaaaagcaaatgaaaacgactgcatctatgaatatccgttcagatgcgtctactacagcagcagttaccggctcacttactgcgaatacaacctttacggcagttgcggtcaaaacaggaacgagcgtcaatggcaatacaaattggtataaagtttctggcaaaggctgggtcagtggtgcgtatttaacagaagtaaattctggttcaacatcaggcaatgcaaatgataatactgtcaatactggaatcaaccaaaagatgaagacgactgcgacattgaatattcgttctacagcatcgacgagtggcagcatcgttggctcattgagtcaaggcagcactgtgacagcaacggcagtcaaaacaggaacgagcgtcaatggtaatacgaaatggtactatgtttctggcaaaggctgggtcagcggcgcgtatttaacagaagtaaattctggttcaacatcaggcaatacaaatgataatactgccaatactggaatcaaccaaaagatgaagacgactgcgacattgaatattcgttctacagcatcgacaaatggcagcatcgttggctcattgagccaaggcagcaccgtaacagtaacagccgtcaaaaatggtactagtgtcaatggcaatacgaaatggtactatgtttctggcaaaggctgggtcagcggcgcgtatttaacgagtgactctagctcatcgtcgaatacatcgaatacaggtgattcgatcaatcaaaagatgaaaacgaccgcgacattgaatattcgttctacagcatcgacaagtggcagcatcgttggttcattgagccaaggcagtaccgtgacagcaacagccgtcaaaaatggtactagtgttaatgggaataacaaatggtactatgtttctggcaaaggctgggtcagtggtgcctatcttacgaagaccgcgacaaatgcttcttcaagtaatagttctgccaataatagttcttcgactaaatatcataccgttaaatctggggacagtctgtggtctcttgcgcaaaagtatggtagtagtattgaccaaatcacttcatggaatcgcttgtccaataatatcatttatgttggtcaaaaattgatcgtgaaatagtgagacacctgatttcatgcaactcaaaagaaaatcaatcagcattacccgatacacattcgtgatatcgggtaatgcttttttgctggtttgttcgtaataaaaatcgctgaagatagatttatttttgaatggtcttttagaatcattctgtttacatctgtcaaagaatccaagcagattttggttccgtcccccctatggagtttcctattttttaggtaaaatagaaaacaaagaaaggagtggagagtatgaagacgattgtttatagtgggatgatgaacggattgacgattgatcgctcacgacgagatagtatctacaatatggtgaagcattggcattctgaatgcgaaatccaatattttatagaagggaaccgctattttttgattggagaaaaaacctataaaatccaacctggtacattggttatgattcaccccgactgtgtccacaatacattctcaggaaagtatatttatcatgatcgtgtactcgttctctatgaagccagcaaatttccaagaatcgctcaatccatgggaatagatctggagaccttttttttaaaacatcatggtatcattcagattccgccagcggatcgctcttacgtacaaacgctcttagcgaaaatcgcagatgaagtgatccacaaagaatacaattaccaggtaatggtcgaaacaaaattaatcgaactttttatttttattcagcggatcaagaacttcagggggctttctgatgaaccggcagaaagtttgggaaaacaaagcgagctagttaatcaaattgcagcctttattcgtcggaactatgcatcgattcattcattggaacaaatcgcttcgtctttttatctcgacaaatcctatttatgccgtatcttcaagcgtgcaacaggctacaccatcactgaatataccaacattcaacgaatccgtcagtctcagcgattactggaagatacagattgggatattgctgaaatagcgagaaaaagtggatacagcaacattacctactacaaccgtgtgttcaaaaaatatacagagacatcccctttgcaataccgcaagaaacaaattgcatacaaagaaagtctgcgagaaaaaaataatttctaaatagtcactcatctttgcacaggcatgaaaggaggattattttcctgttaaaaaagtcaatattgtacaagttcgcggatattacgtcacttttttgtgcaagttttgcttgtctattgctgagacattttttgtccgataaaatcagtaagcggatacataaatgaaaaattgtaaacgtgtgcattttatggaggaggaaataatcagatgaaaaagaagatattggttgccagtctttttagcactttagttctagcagcgtgtggatctcagcctgacactactggttctggcagcagtggttcaacaaaagatgcagaagcagtgacgattaagtttgcttggtggggagcggataatcgccatgatgcgatgcaagatgtggtggctctttttgaagaggaatatccgcatatcacggttaacacagagtatggtgcgtgggatggatggcaagaaaagacattgactcagctatccggtaaaactgaagcagacgtgatgcaagtgaattacaattggctcttttcattcgggaagggcaagaatatctttatggacttgaatgaggtcagtgactatttgacgctagacaattgggaaagttcttatttagaagcgatgcaagtgggtggtgaacaagccgcggttccccacggaatgaccggtcgggttcctttgatgaaccaagcactttatgaagccaatgggttggaactgccaacgacctatgatgatcttttggcagcgggagaagtcattgcgaaagggaatacgccaactggtgaagacaatcagtacgcatatctcaatgtgggagagttctcattagatctatttattgctcagatgctttacaactatacagggaagatcatgcagaccgctgggacagtcaactatagtgtggctgaagtgaaagaagtgcttgaaagatataaagaattggaagatgctggtgcactgccgacttttgagcaaacaagcccaatcgatacggaatcaaaccctcaatgggtagaaggcaatgcaggctctgtttatgagtgggcaaactcactggcgaaatggacaaactcatacaaaggcggcgacgggttagatgagttagttgtaggagatttcttgcaagtcgatgctgactctaaaccaagtatctatgtgaaaccaaattttggctacgcaatttcaaaaaattcgaaacatcctgaagcagcagccacttttattgagttcttgtttaccaatgagcaagcggtgaaggctgccggagattctttgggtatttcaagcaacacagtttgttacgatctgcaagtagcgaatcaactagtcgaaggtgctgtggctgaagggtacgccaaattggatgactatgaacaaacggtgttagatccatactttgaagacgaaaatgtgcggggagaaagatatacggtttacgaggcatttcggacaggaaagttcacgtcggaggaagctgcgaagcaattcattgagaaacagcaagcagcacttgataagtattaccaagaataggaagcaacaagaaggaatgcgagacttagctacgtcccgtacccttctttttccgaaataaaattggacatgagtgagaatgtctggaagtaacccattagtatctgggcgttcatttagaaggtaaaggagtcaaatgcgatgttgaaaaaaatgaaaagaacaaattgggtgatctactgcatgctcatgccatggatcattggcttcctagtctttaaagtttacccaatcattatttctttttactacagtttgttagaatatccgattttaggtgatccggagtttgtcggattacaaaattatctagagatttttacaaaagacgatacgtttactgcgagtttctttgcaacaatcaaatatgtgttgattggtaccccagcagttatcattgtctcttttgcagtagcagccatcttgaattttaagcttaagggagtcaatttctttcgtaccgcttattatattccttctattttaggaggaaatgtagctgtttcaattttatggaccatgctttttgatgtcaacggacctgtgaatatggtgttgagtgtttttacactcggaaacgatgtcgccattaactggacaaaagatccaaagttcgcgatttttaccctgattattttaaaaacttggcaattcggttcgaccatgttgattttcttatcggcattgcaaggtgtttctaaaacagtttatgaagcggcagaaatggatggggcttcaaaaataagacaactgttcaatatcactgtaccgattattacccccgtaattttgttcaacgccgtaaatgtattagtcaaagcgtttcaagagtttaactccgcgtatttaatcactaaaggtggaccaaataagacgacttatttcttgaatctttatatttatgatcaagcctttcaaaatgggaattatggctatgcgagtgcactaacatggattttgttggtgatcatcggtatatttacggttattattttcaagtcatctgatcggtgggtattttataatgattaagggggctgaataatggaaatgagtaaatctcgaagacggatgaatgaaatcattcgttatggattattgattggtgtggggattatcttgatttatccgttgttttggatgattggttctgcgtttaaagagaaccgggacatttttggtagcttgagtattttcccgccaagtgaccgtgtggttacaacgaatttttccgatgcttggcagttgacgcgagaccattctatctggtttttctttgggaatacactgaaatttttgattccaaaaacgatttttacagttttatcttgtgtgattaccgcctatgtgattgcacgaaaatcgtttaaagggaaaaaatttgtctttggtgccgtgatcgttacattattgatgccagaactggcttttcgcattccactgtatctgttgtaccgtgaggtgggacttttggatagttttgccagcctttatgtagcggatatttttgctagttcttcgttttttgtatttatgatcattcaatttatgcgaacaattcctagagagttagatgaagcggcagtgatggacgggtgtaatgaatttcagattttgttcaaaatcatcattcccgtaatcaaaccaattctgattaccgttgccttgctaagctttatgtggggcatgaatgatttccaaggaccattgatttatttgaatagttcagataaaacggttctatcagtagcattgaaacaattattagacggtgaagcaatggtctcctatgggagagtattcgctgcttcttgtttggggctgttgcctatgatcgcaattttctttatgggatcacggtactttattgatggtgttgcttctacaggaagtaaagagtagtcatatgttgatcagaagaattctcgcacaaatcgttgattttgttttagggattttaaccatatttcttatctttgtaggaggaattccgctaatcggtcgggtcatcaataatgactttgttgctgttttgactgcgatttgtttgatgtgtgttatgtattttgcactgcaatatccattcatgcaaaatcagcagacgattggaaaagcattctttcagctgcagatcgtttcaacagataaatatcgcaaaaatgttccagtggcagtcatttttcaacgagagattttatgcaaactagccagctgtttcttcatttgcctgccgctactgtttggcaaagaaggagggcatgaggcatctacacatacaaagttaagaattggtaaaggagaaaatagttggaagaaataagacaatttttggatcaagtaatcgcacattcttcgccagaagcacctatttggaatcaagaggctcgattagccaatcatccaatccgttggagttatatcgatggctgcatgattctggcgatccaatacatgtttaatgcaacacaagacgagaattatcttgcgtttgttgaaacctttattgatcactacattgatgaggcagggaatccattggggtacgatgaaaaagaatataactgtgacgcaatcaatgaaggaaaactattgtttcagttatatgcaatcactaagaaaagcaaataccgcaaggctctagataatctgtatcggcaagttttgttgcaaccgcgcactaaggaaggaagcatgtggcataagctggtctacccgcaacaagtttggctagatggtttatacatggttcaaccatttgcgatccaataccaactaacgtttggcaactccgcagatgttagtgatgtgattgggcaattcaaaaatgtcatggagtcaatgaaagatccgcgaacaggattgctgtatcacggatacgactgtacgagaactgcattttgggcgcatccaaagacaggttgtagcgcaaacttttggactcgttctcttggatggtatgctatggcattagttgacacacttgaagttttactgtcccatgaaggctatctccaagaaaagcagcagttgcagcgctatttaacagaacttgtaggtgcagtaatggcttatcaagatccaaaaacgagtctcttttttcaagtaacagatagaccagacggtgaagacaattatttagagacgagtggatctgctgctttgagttatgtgatgctaaaagccagtcgattagctattcttccttcacaatataaaataatcggcgagacgatcctacgcgctcttgtaaagcacaaattggttattaaaaacggagaatttacattgaaagatatctgtttagttgctggcttaggggggatgcctggaaaaggcaactacaaaatcagagatggctcctatgagtattatatttcagagccagttgtcaacgatgatgctaaaggcatcggtccgttcgtttatgcttacagtgaatggttgcaactgcagaaccaataaagacagtgattcttatcattttcgtaagcgcaaacaaaccatttggtctccttcgcagagtaagatacaatgaaatggtaggcaacttccttcaatgaaaaggcaagtgctgaaagatagaccgatttcacgcgtacacaaaataaggaggctttcaaatggataaaagaaacctgacgattattggcagttacgacactcgggctgaagcattgacagcaattgatcaattgcgaaacgaagggtacaacaaagacgacattgttttgtttgcgaatgcaacgatcatcgagcagtttggcttagatacgttaagtagtgcagaagtagaagcgactggaggatcagatgatgatcgttcaatgtgggaaaaaatcaaagatgctttctcatttggcgactatgaccatcggacgattgatgatgagagtgatcctttatttgcctatcgtgacgaccttgagcaggatcgtttagtggtaggagtctacgattatcacgcaaccgatcgaatcgaagaaacagatacagcgatcattgatcagcctgttacaggtgagacagcaatgcctgatgaatcggttcatccgacccctcgaatgggagatagtgatatcgaaacaccaattaatgacccaaatcacttgcgtaatttataaaaaagatcccatccagtaaatggtcggcttataatcaaagaaatagcagccctgcaatggctgttatttctttgtatttcagatgttaagcttgtaaaatacgggacaattgctgcaacgaattcttaatttgttgctcgtttcttttttttgtataatagatggagaaaaccatttcttcaaaaaaatgcacggtacttcatataaagagaaggtgagggatagcaatgaagttgaaatttaatttgcagtcagcactcgttagttgttttgtcacgattatgttgagtatggcaattgatcaagacgtaaatgcttttgttgcggccccgttccagcgcaattcttcggagccatcttctgaagcaccagtgcaggttgccgaaacaagtacgtctgaaacggaaacaaccagtgaaactttttatgaagcacgggtcagttcctactccgaaacaactgcacagaccagtggaacaaaatcaaatgaagattcatcggccattccgtctacagaatcagaaagtatagctgacagtagtgaagcagtagtgaaggagacagatacagcatctagcacttccaataatggatcagcaaattctgatactacgactagtacatccgaaacgacgagctcctctagcagcagctcaagtacgagtagttcaacctcttcatctagcagttcaagcagtacaggcacaactacttctgacgaaagtgaagagagcacagaagctggtgatacaccgattgatagtaatgatccggccaatgctgcggatggatcagaaccattaaaacttcttttagaagaaccatttgatgccttttttagataagcgcttcggctaagatagtcagagttttaaaccagcgaatcccttacgactattcatctatttgctgaagtattgagtgattattttgtgcaataaaaaagcatctttttcaagcatatcacaaagtaatttcattaaattcgcttataatgaggtgaaaagggggcgcgctatgggcaaatattttaaaaactttgaaaagctgatcagtgctgttgtcgatattatgttagcaattttagttgtattggtattggttgtgatggcagaagcaatttataaaatcgttacttatgtcattcctttgacaaaagtcagtgatctatcctttttgattgaagagattgctacactatttattttacttgaaatcattttgatgttattgcggtatgtaaaagaaggacatcatattcctgttcgttatctgattctaatcagtatcacggcgattttacgtgagttattgttggcacaaggaaaaggactggagacgttgtttttggcgctggcgattttagtgctgatttttgttttacaagcattagagaagttgaaatcttttcatagctccaaagatatctgaaaaataaatcagaaagttacttagaaatcaaaaataatcctatcagtaaactgaatgtctcagttattgataggattattttttgcgaacaaactagcactttctgcttgtagttgcttcccaatatccgtttgccgtacagtgattcgtttggtttggcggaggatgattttcttttgcgtcattagatccttccgctccttgattgctgtctgacgatctgtaaatggttggtgagcagcaagtgtcatcccaaaagaattggataacaatgtgtaaccggcgataccggtaacttcctgataggagcgggataagccaccgtcaattaccagtaggtgcccattggctttgattggcgtctctccttttttcacttttactggtgtgtggccgttaatgatgtgtcctgtcgagtctaatccaaacgcagcgaataagcgacggcaaaatgcttctttttctcttagggtatagtaggcgtttttttcttcaatatgcgtgtgtttattactgatgaaatagcgctcgaaggttttcatggattttttaccgaaaagagaagacccttctccgcaccagagataccaaaggacatcggtcgccagatcgtcggtcctttctggtgttgcgaaactctgttttacacattcttgaaagaaatccatcaatgctttgccctgataagaggtttttccaaaggacactgaaaggaagcgaccatcaggatgacaggggatgcaaccgtggtacagtagattgccattataaatttgatagatcgtgcctttttctactagaaaacgtacatgggttgctaacctttcggaggattgaaattgtttgagaagatcctccagtactttttgctcttcatcagtcaaaagatagggtgcttcgggatcaaccaattgaaagcaagcatggatcagaggctcaaagtgatcctctagctgaatctgcaaatcctttgtgattttacccaatagcaaacgatccgctaattgaaattcggggcgtcgtttgatcacagcggcctctaccttgaattgaatgattgcaaaggcttgctggagaagcatggcgtcgtgaatttcctcttcggaaagatcatcaacagttttcttaggataaaaccccttattttcttgataatgtttacgactaaatgctatggctttagagaggtcgatgccatagccttctttcaacaatgctaaatttccataccgtgcagcgatccgtatggtacttgccaaacaagggaaagaaccgcagtaactcccgatccacaaaatatcatggttccctaattggatatccaaagaaggaagcgccatgagccggtcgatgattttatcaggtgcgggtccccggtcataaatatccccaataacatgtaggtgatcaacgacaaaacgctgaatcaaaaatgctagctgttcacaaaatagaggcgctaaggataagtcgatgatcttatcaaaaatcgctttataataggcttctttgttgaagtccgagtcatattgatacagcaattcttctaaaatataagcaaattgttttggtaaagcttttcgaactttggaccgcgtatatttgctggaagtaaaacgagccactttgaccagttgagtcattaattggatccaatcctcatgcggatagtctttttcttgcaatacttcttttggatagtaaatcaaaaaacatagctcggtcttctcagcagctgtcagtgagtattgaaacaatgtttcgactttttcccgaatgctgcctgaaccattgcgcaagatatgatcaaaagcttcatattcaccgtgcagatcactgacaaagtgttcggttgctttaggtaactgctggatcgcctctaaattgataatctcaatgaaatcatttaattgatcttcagtgtgcataggcattatttttgtaaaattcttcgatcaacatcgaactttcttcgatcgaccgtttgctgacatcgattacattgattcctagctgttggaataattgattcgcataggctagttcatcatcgatccggcttggttctgtgtagttagtagtttctttcaaccctaatgaagccagtcgagaacggcgtatttcgacgagtgagtcagaatttgtagtgagcccgatcatttttttgggatcgatttgattgatctctttgggtaaagcgacctcaggtattaaaggcagattagccactttgtaaccacgattagccatatatagacttaacggtgtcttggaagtacgggaaacaccgagcaatacgatgtcagcatcgagaaaaccacgaggatccttgccgtcatcatacttcactgcaaactccattgcagcaacacgactgaagtattcttgatttaaacgatggattgcgccaggttcctgaactgcttgtagcccgacggttgcttcgattactgagatcaatggcgtcatgaaatcgacatgttgaagaccggtgcgtttagcaaaggcttcgacaaatttcactaaatctttgttaacaagcgtcgtcacaacaatcgatttatccagtaaagcatcttgtaagatttccaataagctctcttcatcatttgtaaaaggatacagttgaatatcggatagatcgatcgtaggaaattgtgcggaaacggcactaatcaatttttgtgctgtttcaccaacggaatctgaaatcaaatatagtcgaacattcttcatttttttcgctccttagaattgattgttttcgatcgcattgcctgcttggatatagtagttcataattttagacttggttattttaccaatgactttttttggattctcagcatcaacaacagggagtgtatctatttcatgcctagctaataaggtacctgcagtcaaaatagtttggtcggcagtaatcgtgacgatattcggcattcgcgtcatgatcattgccaccggtgttttttctgctgctgaattgctgatagcgaagcgcagaaggtctttgcgggatagaacaccaattagttcctcttctgcatttttcacataaagagacccgacatcatacatgaatagggttgtcacagcatcatataccgaaacggattgctcaatcattaacggtgggatcataatctctgctacttttgcatggtatagcttatcaaacaacagcggttctacggtctgtccggtataaaaataaccgaccttgggccgggcatcgagtaatccagtcattgtcaggatagagagatcattgcgcaaagtagcacggctgaatcctagtttttttgcgatggtttcaccactgataggttgattgtcttttacgatttcaatgattttaagttgtcgctttgtcaattccaatgtgtcaccttctttaaataaatgtgatatgctatttattatatattttccgcgtggaaaatgcaataaaggattttggcgcgaatttttcttaaaaatttcttcttgacgaatcaatagtgtacgctatatacttcgttttaagcttaatagtatatcacattaggaaggcggaaaaaaatgaagaatatcgtttggttctcagaaggtacgaaagatcaaaaagaattactaggggggaaaggagcaaatttagctgaaatgaccagtatcgggttgcctgttcctgcgggatttattgttacaacagatgtttgccgacaatttttagaaaaccagcaacttacacagccgttggtagaagaaattattcgagcagtagctacattggaagaacgaacccacaagtcttttggcggaaaccagcagccattactggtttctgttcgcagtggggcaaagtattccatgccggggatgatggatacgattctcaacttggggttaactgatcaaacggtacaggcgctggcagcgaatacaaagaatcctacatttgcctatgattgctaccgtcgccttatccaaatgtatggggatgttgttaaagggatcgataagagtcattttgaatcctatttaacgacctataaacataaaaagggatatccttctgaccaatcaatggtcgctccagactggcaagagatttgcgaggttttcaaaagtatttatatggaacatacgcaagaacgattccctcaagatccgctggaacaattattatcagccgttcaagctgtgtttcgttcgtggaataatccccgggctatcacttaccgtaaaatccacaaaattgctcatgatctaggaacagccgtgactgttcaggaaatggtttttggcaatagtggtgctgcaagtggaactggcgttgcttttactcgcgatccgacgacaggacacagaggattatttggtgaatttctcgcttgtgcacaaggagaagatgttgtcgcgggggttcgtacgccaagaccgattagtgatttagccaaaacacaaccagaaatccacgcgcagttttcggcgattgccgagttactggaaaatcattacaaagatatgcaagatatcgaatttaccattgaagaagggcgattatttgttttacagactcgtaatgggaagcggacggccaaagcagctgtacagattgctatcgatctagtttctgaaggaaagatcacgaagaaaacagcactgcatcggttgacaccagacatgctggatcagttgctgcatcctatcttttctccggaatctcttgcgaaagcttctcctcttggtcaaggattgcctgctagtcccggtgcagcggtaggtcgtgtttacttttcggcagaagcagcggttagtgcacaccaagcgggagaaaaagtcatattattgcgacaagagacttcaccggaagacattgacgggatggtcgttagtgaagccatcgtgacttctcgaggcggcatgacttctcatgcggcagtcgttgcccgaggactaggagtatgttgtgtggcaggttgtgatcagttagctgtcgattcatttttgaaacaagctcgatgtggtgaagtaatcattcaagaaggagactatctatcagtggatgggacgacaggcaatctgtatcaaggggcgctatcactggttgcctcgcaagattttggtttgctgcagacgattttagactggtctaaagagagagcagacttagtggtacgtgcaaatgcggaaactatcgaagaaatcaagacagcagcttcttttggagcagcaggtatcgggctagcgcgaacggagcatatgttttttggtgaagctcgaatctggccgatgcggcaagtgattttagctgaaacgaccgaagaaagacaagtagctttgtctcagctgaaaacgtttcagttaaatgacttcaaggagttattactgcagacaaaagaacagaaatgcgtcattcgtttgttggatccgccgttgcatgaatttttaccgcgaccacaagaatatgaagaaatggccaagcgcagcggctattctctagaaaaaatcaagcaacgaatccatgatctacaagaagtaaatccgatgatggggcatcgaggaagccgtctaggaattacttatcctgagatttatgagatgcagacagctgcaattatcgaagcggcactacaagcttctgatgcaggaagtgttgtttatcctgagattatgctgcctttgatcagtattccggaagaaatgcgcgttttgagagaacgtcttgaaacgtacattcggcaaatttttgcccactatcagaaagaagtacctttcaagattgggatgatgctagaaacaccaagagcatgtttattaacaaaagaattagctccgctagctgattttttcagttttgggaccaatgacctgacgcaaatgacttttggattttcacgggacgatgctgctggttttattcaacgctatttagataaaggaatcctgtctgaggatccgtatcaacatcttgataaatcgggagtaggacaactaatggaacaagcggtggcttcgattcgtcagcaaacgaagggaaaagcgattggtgtttgcggtgaagtaggcggtgatccacaatctattgcattcttgcgggctattggtgttgattatgtttcatgctctccatatcggattccagcggcatggttagcaattgctcagtctgcatcataattgcttatactctgaccatctatattgctacttgagtggagtctgcaatgaagttgttaacatgcggtcattatcaacgaattgtctgtttttctaaactgttaatttatgaatagctcgaacattctcaagtaatttgatcttcagtataccggttttctaaaagagtctattactatcgttctaaaagcccacctttggctgttgaaaaaatatatcgttgttttttgattctatggaaattcttattgtgctcgtttaactaaaccatgcggtatcaccgtatggttttttagttgattctacaaggtttttagctattgttttgagtggtttctcctacaggacgatttcggttcagtgttatttgtatggtggaaaagcaatggctgcattttctactaatgaacgctcttaatagttcggtgaaatgaccgattatctttactgagggtcgtcttcagacgagtcttcattggatagtgtgaaattgtaaatgaaggagtggcacatttgtgaaaaaaaggaaaaaaacgataggaatttatgtgatggtcaccttgattttggttgcggggatcccgatcattgtcatgctgacaagttcttatttgaccacaaaggatttattgattcaacgaaatgatttgaataaagaaagtgccgttaatttgattttggcggaagaaaaaagcttacgtcaatcgacggaaagaaaattgaagtcaatggctgaactgccatccatgaaaacagaatttagtatggcacgtatccgctcagatctttctttagcaattgctggaaccaatagctttctagaagtgacatttggaacggaagatgatgagtatgtgaccttcaaccctttgccagatgattacaaaccaacgactcgtccttggtacaagggggccgttaaagccgaaggagaagtatattggacagacccatatttggatacggtaacgaaccaatttgtgacatcagcctccattatgattaagaattcccataatcaagtaggggttttgagtgtagatgtttcatatgaaagcattcaagacattttgtctgactttaccgttggacgaacaggaaatattacattagtttcagaatctgggatcattgtcacttcaaagaacacgaaacaaatcggtaagaatatcaaagaagaagaagtattccaaaagatcaaagaagcaaaagatcctaatggtaaggtcggtttgggcgactcaaataaagtcaacgatgtgttgtacgacaaatctgctgattccaatgtttgggcttattccgaagtcaaagccagtgatttagataaagagttaggagcgttagtccgcacgacgatcatcgtcacaatcctgatgttgctatttgtaggacttgtttcctatgcggccattaaaatagtagcagcgatcatcgattgtttcaatcactactttagaaaagtcggtgaaggcaaactagagaagatgagccagtctaaaagagttaaaggcgaaaaatggacttgggaccagttagcccgtcgagtcgtttatccagataaaactgggaatgagattcagcaaatggcagacaattataatgtgatgatcgaaggcactggcgcattgatccaaaaagtgcaaaaagaaagtagtagtgtcgcagaaatgtccgattctttattggaactttcaaaacaaaccaatattgcgacagaagaagtctctcaaaccatcacgggtattgcagaagttaccggtgcacaagctcaggaaacagaatatagtgtgtcgcaaatgcaaaatcttacgcaagtaattaaagaattacgagataacgttggcggaatgagcagcaagtcgcaagaatccacgaagattaatcaagaaaacttaacgatcatggatcaagtcgatgacagctggcgtcaagaattggcacagatggaacgcttaatgtcaaacatgacgggaatgaatgatagtatccaaaacatcaattcaatcattggggtcatcaacgatatttcttaccaaacaaacttgttagctttgaatgcttcaattgaggcagccagcgcgggagagtccggtaaagggtttgcagttgttgctgctgaaatccgtaaattggcggagcaaagtaaagcttctaccaaagaaatcgaagcgattattgaagaaattcgtgagcaatctagtcaaatggtcaaacagacgtcagcttctgtaaaaggtggcgtacgacaaaccaacttaattaaagaagcaatttcgtcttcaaaagaagtatttcaacgcagcagttatatgattgaaggtattcatcatattgaagaagcaagtgcacgtattgaaaacattcaaaatagtgtgttggaaaacttagaaaatatttctgcatcaacggaagaaaatgccgctggtacacaagaggtttccgcaaacgcggaagaagttttagctaccatggatgaattcaccaaccatgtggcagacctaagagacatcgcggaagaattgaagcgattgactaatcgatttgaagtggaaaaatagaacaagaagaaaacattcatcagctattcgaaagcatagctggcgaatgtttttttactatcaaagaagatgctacaaaaaaagccaagactgatgtcagcagtcttggcttttcatgaagatgtttataaacaattattgctggttagtgagccatttctgtccgctggatgatcatctctacacgacgattttccgagcggccttgcggggtgttattatcagctttgggttccgtatcagcaaaggcttgaattgcggcattcttttctaagacggcccctttactgatgaaatactccataacgttaatggcacgggctgaactgagatcccagttggattggtatcggccattgcctttttccggtacgttatcggtatgacctgcaatcactattttgttggtttttagttttttcagtgagtcagagagcaaatccagtgactgccgagtggtggctgtgatctcagcactgcccgatgtaaacaggatactgctagccaaagtgatatggagcccatcagattctaagcgaacttctgtttgatcttttaggcctgaagaagctaattcttgtgatagctgatcgctgattttttgcaattgttgattttccagttgagtccgtacagaggcttcctgtgcttgtgcttccgtagatgtgggtgctttttttcccgtattagtctcccccatatcgatcacggatccgatcacagaggagctgctatggtgactagaaaggatggtgccaaattcacttctgatttcttgaaatttctcatcatcgactttcgccatagcaaacatgacaatgaataaagccagcagtaaggtcaacatatctgagtaaggcaaaagccacgcttcgtctacgtgttcttcatgtttcttttttcgcttcatatcggttcatcctttataattgttcttcccgttttttaggatcgatcaagctatataacttcttctcaatgctttttggcgattgtccggcttggattgctaagaccccttcaacgatgatcgacatcatttggacttcttgctcagatttcaaggatagccttgagctaaagggaatgaacagaacataaccgaagaaaataccataaagagttgccacgaaggcagctgagatcatgtgtcctaaagcttctacatcttctagattgcctagcgccccaatcagcccgatcacggcacccaagacccctaaagttggagagctagttccagcggttttgaagatagacgagccaatacgatggcgttcttctatcccatagatctcattctccatgatttcttgtatctgttcggcagcaatgccatcaaccaccatttctaaaccttttcttaaaaatggatcttccaagttttggatggcgccttcaagagataataaaccatcacgacgtgcttggttggccaattcaacaatcgtattgatcgttgtttttaagtcgtattctttatttttcagcagagcgccgaagattttcgggatttttttgatatcactgctgggaaatgaattgataacggctgcgatcacaccgacgaaaataatgattgcggctgcggggttgattaggacagccacattggccccttttacaatcattccaaccaccacagatatcaatcctaaaataataccgatcagcaagaaaaaatccatttgttgcgtcctcccaaattctttattccgggttttaacccttttctatttttatcggtgaattaaaattattcttaatagcaaaaaaaataatcctaaaaataactgagataaaattactgattcttttaatttttgtttttttggataaaaagtccaagcttttttatgaatggtatagtttgtagatcctgtggaaattttcagatggtatcgtttttttggtgaagtatttctcgtttttttaccatttatacaggcgttcagtaaaaaaagttaatcatttatatacataatgaacgtttttttatcaaaatgcatccttttatagaaaactaaagatagccatataaagcgtttaatcgagagagacttctttttaaatttgctgatcagtttgtgatgaaacctaatttaataaataacataacatgattgtaacttaactgacatatctgtaaagttgtaaaatcaaattgtaaaataaaagcaattctactataatgacatcacgaatgacatcacgtgttcttgtttttttaatctataatataaaaaaatattgaaaaaaataaatatatttttctctggcccataaaaaaagcatttggtacagaatatggaaggagcaattactgttggatacctataatttattaaaaacagccatgaacgtttctgcacaacgcgcagaattgatttcgtctaatatcgccaatgtcaacacggatgggtacaaagcaaaacgcatcgtgtttgaaagcgaattaaagcaggcactcgcttcatcagggacggacgctgcaacagaagcgtcagtttctcaagtaaaaccgaaaatcactgaaaatgcaactaccagcatcaaagacaacggcaataacgtggatcttgaagtggagatgttggatcaagtagccaatgggttatattacagtgcattgaccgcacaagtcaacggacgcttgcaaatgatgaaccttgtattgagtaattgatagaaagcgcaggaaaaacaaatgggtatgtttaacggactaacgatcaatgcgagcggtctagcattggaacggttaaaactagatacgatctccagcaatatcgcaaatgtaaatacgaatcaaacacaaacaacagctgcttatcaaaaaaagagtattcttttttcagaaaatttaaaaaatagtcgcgaaggaacaccggctacatatggtgtcaaagtgacggggatcgctgccgatgagacagaaaagctgacctatgatcctaccaatcccgctgccaacgatgagggatatgtcggtcaatcaaatgtggatattgccgatgaaatggtggcaatgttgcaagcggttcgaacgtacgaagccaatgtttctgcatccgaaatgaataaaacgatcttgaaaaaagcattagaaatatcaaaggggtaacgagaaaatggatggacttttaacgacaggattaacagactaccaaaacgttttgcggacactaggcacgggggctgcttcaaacgagaccagtgttgcaggcgccaaggaaaatcagttttcttcctacttgacccatgcggtcgatcagttgaatcaaaaaacgacggtcatggatcaagatactgtaaatttgatcaccggcgatgaaagcgatctaggcaatgtgatgattcgtatgacggaggcgcaactggcgctacaaacagccgttcaagtaagaaacaagtgtttagaagcttacaatgacgtgaaaaatatgcagttttagcagtgggtgagggaataaggataaatgatggataaagtgaaagaatggacagaacaactcaaagaccgttggcaaatgcaaagctctttaaagaaaatgatcgttgttctttccgttatcagcgttctcggaatcacagcagctgtttattatttaaatacgcgaattgaatacggtatcttgtttacggatctgagcgatgccgatgcgggaacgatcagcaaggatttggaggaacagcagatcgcctacaaattagctgacaatggaacgacgattttgatcgataaggaccaagtcgatgaataccgcatcaatcttgccgtggacaataagttaccaaataccagtacaggctttgaattatttgatgatgccaacatgatgacaacggacgaagaccgcaaaatcatgtatcagcgggcagtaacgggcgaactacagcgagcgatcgagtcgatcgatgcagtcaaatccgccaaagttttactcgtgatgccagaagaaagtgtcttttcttctgaggaaagtgcgccaaccgcctccatcgtgttgaccttgaaaaatcagcagatctcagacgagtccgtgcaagggatcgttaccttgacttccggcgcagtggaaaagctgaagccagaaaatgtaaaagtcgttgatagcgcgggcaataccttgactagaaccgaagatgaagccagtcaattaagtggcctgaacaataaatacattgccatcaaagattcctatgaaaaaacgctagaagaaaaagtagcgaagttgctgacaccgatctatggtgcagacaaattccaagtgtcgatcaatttagacttgaattttgattcgatcgagcgaaagaaagtcacttatgatgacccagagatcaagagtgagacagtgcaggctgctggttcgcaagggaccgtccaagaagcccaaacaggcacggtggatgacaatgtctccaatgtgacgggcacagatggagagggaaacaattcctacagccgttccgttgaaaacgaattggataccgagaccaccacgaccattacggcccctggcatgatcgaacgaatgaccagctcgatcgtgatcaatgcgaacctttcgcaagcggatcaagcagaattgcagcagttgattgctagtgctgtcggctatgacaatgaccgtggtgatcaaatcgcgatccaaggatttgactttgcccaagcagaggttgatccagccgctgatccgcaagggaatgaaccgattgcagctgccaaaggttatctcaagtatgccatcatcggcggcatcgtgttgaccttgttcttagtgatcttaatgatcgttggcgtgatccgacgtcgtcgtaaagaagacgagctggaagtcgatgtgacggaggaaatggtcacttttgcacaaccgtccgtagttagcactggagcaagtccgacagttgcacaagaagtcgtttttggtggtgtcggcaatcggtctgctgaaacgaaaccagcggcgccagaagcatccacacaagaaaccgcagcagaacattcaggagaaccaacattggatcaaacggctagaaattatgccgaaagcaatcctgaagtagcggcggaattaatcaaagcttggatgaaagaaaaataagggggcagccatggatacaatagatggggtaaaaaaagcagcgattcttctgatctctctaggatcagatacctctgcaaagatcatgaagctgctgccagaatcatttatacaaaaagtgagctatgagatcgccaacatcgactttgtcagtcccgaagagcgggatcaagtgttggaggaattttctcataccgcaacggcccgcaaatatgtcttagacggcgggatcgattatgccaaaaatttgctgaaccaagcattaggccctcaaaaagccaaagaagtcattgacgtattgactcagattcagctgcgggaacggccctttaatatcgctcgcaaagccgatgttcaacagttgaccaatctgttgatcggtgaacatccacaaacagtagcgttgattttatgctacatgcagccggacaaagcggccagcgtcttgtcgcagtttcctgatcatttgcaagtggagatcgctgaacggatcgggacgatctccagtacgtcgcctttggtgatcgaacggatcgaaaaagtgatcgagaacaaattctcgaattacattgagaacgatacggaaaatgtcggtggtgtgcacacactggtagaaatcttgaactcagtcagccgcagcaccgaaaagaacattttgaacgacttagaaaagcggcaaccagaactatccaacgaagtgaaatccagcttgtttactttcgaggatatcgtgaccctcgaacgcttggatgttcaaaaagtcttacgagatgttcaaaacgatgtcttagtcttagcgcttaaaggcacgaccgatgacatcaagaactttattttctccaacctctcatcacgggcggtggaaaatctacaagaagaaattcaatttatgggtcctacccgcttgtctgctgtagaagaagcccaacaaagtgtggtggctgtgattcgacggctagatgaaaccggtgagatctacatcggaaggggcgaccaagatgcagtggtcaaatagcagtttattgaagcagcaggcggtcaaaacgaccgaagctgctcgcagtattttgacggatacgaccatcaaagtgccgattgagaaagcaagcttagacccagaactgcaagcggctagacgtgcacgccagttggagcaggaacggcatttgcagcaaatggaagccttgaagcagcagattttgaccgatgcacaagcacaagcagcgcaaattctagcagaagcgagagcggaaggctttcaagcaggacaagcagacggctttcaacaaggctatcaagaaggactcaatgccagcaaagaagccgcgcaagcattgatgtcacaagcccaagccaatgtcgctgaagccgtttctgagatcaacacctttcgctcagaaaaaaagcaagaaatgatcgcttacggcacggcaatcgccgaagccttaatcaatcaacgttttacagacgagcaagcaggcttcctgccttttgtggagtctgtgctatggcaatttgaacaacccgatcaatttgtgactgttcgcagccaagagcagcatcttgcagcgttgcgagaattgatggaaaccaaaaagcaggcgatcagcgggtttcgctatttactcatggcagatgacagcttggcggaacacgatttttgtatcgaaactgaaaatgccttggtggtttttgaactgaggaaagaaatcgatcgctttttgagccaatttctagaaagcagtgtgaaggaatgacgtttgaattaccgatcacagagatgcgcaaaacggcgcaatcacagccgttttttaccacctacggcaaagtcagcgaagtcgtaggtctgctgatcaaagtcgaagggctggcggttttcataggagaaatctgtgaagtcgcactgcaaaacaagacacatacagctttagccgaagtcgtgggctttgtgaaaaaaaccgtgctcctgatgccccttgatcagctagaaggcatcggacccggctgtttggtgcggccaactggcaaatcattgacggtaaaaatcgatgatacgctgctagggcacacattagatggactaggacgaccgttagatatggcgctggatctggaaagtgcgccagaatatccagttagtcaagattctcctgacccctttcgtcgtcaaaaaatcgctgagatcatgccgacaggtgtccgggcgatcgatggtctcttgactgttggccttggccaacggatcggcatttttgccggcagcggggtcggtaagagtaccttattggggatgctggctcgttattgcgaagccgatgtcatcgtgatcggcttgatcggcgagcgaggaagagaagtcaaagaatttattgaaaatgatctaggcccagaaggctaccgcaagtcggtcgttgtctgtgctacctccgatatgccgcccctcgtacgactaaaaggggctcatgtagcaacggcgatcgctgagtattaccgcgatcaaggcaagaaagtcgtattgatgatggactcggtgacgcgttttgcgatggcacagcgggagatcggtctatcgacaggcgagccgccgacgaccaaaggctataccccttctgtgtttacagctttaccgaagttgttagaacgcagtgggatgtcggacaaaggctcgatcactgctttttataccgtcttggtagaaggtgatgacatgaatgaaccgatcgctgatgcggttcgggggattcttgacggacatattctgttgtcccgaaaaatcgccgctcaaaatcattatcctgccatcgatattcaaaatagcctcagccgcttgatgaagaccctcgtttctgagaagcagcataaacatgcgggggaactaaaagaaaacatggccgtttatgcagaagccaaggatttgatcgatatcggtgcctacaaaagcggcagtaatgcgttgaccgaccaagcgatcgcgctgcatcaccccatcctacggtttttacagcaaaaagtggatgagcggatcccatttgaacaaacgatttttgaactggcgcatttgttcagtgaagaagcgctgatcgagcgccagcgttcaactatgtaaaagagatcataaaggagcagctatgcaagcatttcacttttccttagaaaaagtattggatcatcgaaaaactattgagcaagaagccaaacgaacttacgcccaaaaacaacaactattgattcagcaagaacagcgcctgaatacgctgacacaggaaaaagcccagctttttgatgtcaatgagatgaccattgggcggatgcaagtgcagcaacgttatttgcttgcgttgaatgccaccatcgatgaggttcagaacaaaatgtttcacgtgaagcaagaattggcagagtcgttatcggtggtggtagaagcgcagcaggaacgcaagatcgtggaaaagctgcgagaaaaacaatttgctgaatacatctatgaagagcaattggaagagcaaaagcaattggatgagttcggcaatcgcgccttattttcttaaagaactaatggttttagtgataagacgaccttggtttcaaagcatcagctgagaggaggtgaacaatgaaagagatcacaacaagtgccgtatcccctgtacctgtcggcagcaaatcaaaaaagacggaggcgtcaccagaagccttcagtttgctgatgcaacagctgacggaacagaccgcaagcaatctgtcagcaccctttgaaacatcaggcatgacggagcaaaacgccgttgcaccagaaatgtgggttgccagcagtatggaacatctgccgcaggagccagaaatcacttcagcacccgaacagcttgcaacgacacaagcgccaggaatgagccagatcagccaggcaccttttgcagacttggttcatgaagcgccacaggcatcgatggtaacggcggagcagaaccaaacgagcgccggcacagcagcttctcccgacagtgtttcagctgctttagcaccaatagacgtagccaccacagtcatcaacccctccgagtctacgcttgaaggtctagatttgatgacaaatgacagaagtgaagccgcagcaacaacgcttgaaacgcctttgccagaagacttagtaggcgaagagcagtccacggcaaaagggatcgctcctttcaaggaaatcaaggaaatcgattcagtaacaaaaactgcgattgcggagacgacagaagcacagctgaaacagtccaccgaagggatcgctcaattgggccaaaggggaccattggatcaagcgtcgccagtgacccaccaagcgacggatacgactagtaccttgcaacgcacgaatgaaacagtcgccaaaaaagcggaagctgtttctgcacaagccattgcttcttcaacagcaactgacaatgaaatggtggcaccagcgctgcaactgcttgatgtttctccccttttgaccaagcaaggacccacgccaacaaaagcgaatatggaacaagcggtcctacccttagcaaaagcggctgcccaactcgtccaaacgagcagcacggcaagcgagaaaaaaatcacgctgcaattcgttcctgagaaattaggcacgatccagctttctctagaaacgaatgcccaaggcagtcgcttagaactgactgttcagcagccgcaagccaaagaattattgctgtccatcaagcatgagctagagcaagttttgcaaaagcaagagcagccgatcctagtgatcaaagaacctacgttagcttctgtccagcaggctggtccgctgtcaaatcaatcctttgccggcagtatgatggcaagtgacagtcagttaagccaacagcgttttttacaggctcaaaaaggacaaagcaaaaagccgtttcatcaaagcaatacggctgaagaagagcagcaattagcaccgatcgatcatgcgatcagtattttagtgtaaaggaggagaactatggcagatgaaattacagcagctgcggccggtattgccaatacatcggcattaacgcaaacaaaaaaatcttcagatatctccatggatgattttttgaagatcttagcagcatctatgagcaacccatcgatgggaggcagcgattcttctggtggtggtagcaccgactatatctcgcaactggttcaatttacgaccttagagagcttgaatgaattgagcgaaacgttgacgacctcggtgattttacagcaacagcagcaagcttttagcttgatcaataaacaagtcaccctgatggacggcacagaaacattgtcaggaaccatcgaaaaggtccgctttgccaatggctacgccacgatcgtcgtaaatggcaaagaatacagtatgagtgcgatccaagagattggtggcgaagcaaaatgagtttgacgattcaacaggggctgcaaaaagttgccggggagccttatcaaaatccccgcaaagtcgtggacaaacaagccttttcttcaatacttgaacaaaaacaaaacgacatcaaagtctcgcatcatgcgcaaaagcgtttgactgcaagggaattgaccttacaagatgatgattatcaatccctttcaacggcgcttagtgagctagcggaaaaaggcagcaaagaatcactgctcgtttacaaagatatgggcttgatcgccgatgtccattcacgaaccatcattacggcgatggggatgaatgaacttcacacagtcaccaatattgacagcgccacatttatcaaatagcagctggactgaaaaggggctgcaagtattttctgaatgacagaggaaaatacgccaaccataaggaggaaaacaagcatgttacgatcattatattcaggtgtcagtggaatgaaaaatcttcaaacgaaaatggacgtggtttccaataatatcgccaacgtcaatacggttgggttcaagtcaagtcgtgtacttttccaagacatgatgagccaaacgatgtcaaacgcaactgcgccaggcaacgggttaggtggaatcaacgcaacgcagatcggtttaggggttcagacgggctccatcgataccatcaatacagtcggtgccccgcaatcgactggccgcagcatggatttttatatcagcggacagggctactttatggtacaaggaccaggagcaaatggcgaaacctattacacacgagatggcgcattcgttcgtgacagcaacggaaccttgaccaatagtgatgggatgcaagtcttaggtcgttcagtcaccggcggtcaaccggttgtctatgatgacaactttgatgaaaacacagcattgagcggacaagaaacggtatctcccttatcaattccaagtacactgaccgtcaatggggaaaccttgacctataactccatggcaatcgatgccaatggcttagtgttggcaaaatacggcaatcaaacctttgtgatggggaaagttggtgtcgcaacctttaataacccagaaggcttagaaaaagtcggcggcaacaactatgtccaaactagcaactcagggaatccaatcgtcgcaggccctggcaacaacggagcaggaacgctacaggcgggtgccttggaaatgtcgaatgtcgatctttcgacagaatttaccgaaatgatcattgctagccgtgcctatcaagcaaattcaagaagtattacgacttctgatgaaatgctgcaagaattattgaatctaaaacgttaagaacgtgacgcttcatcattgagaggagtttgaccatgattctagtgacagcattgaatggcaagccattctatttaaatccaacattgatttatcggatcgaagaaatgccggatacattgattacactgacagacggcaaaaccttagtggtgacggaagctgcgcaagaagttgcgcagcgggtaatcgagtatcatatggtgatccattcgaaccaagtgaaaacgtaagggtgggaaagatggcaaaagaagaaaaagcaccaaaagcagaaaaagagaaaaaaggcttgagtatggttgttttactgccgatccttttgattgtggtagtcggcggcagtatcggcggtaccttagtgacgaatcactttttgacgggggaaaaaacagcagctgctgaaacagcaaaagacagcagcaaaatctcctcagacgaagcgatcgtggcactggatgaatttttagtcaatctggcaaaagaagacaaccaagagcagcaatacatgaaggtcaatttatcgattttagtcgccgatgaggaaaaaagcgcggaagctacgaaaaatgtggccgtcattcgtgacagcgtcgtaaacttattgcgccaacaaaaggccagcggtattttgagctccgccgaaagtgtaccgaatttaaaaaaagcattgaaagaaacaattaatcaggaatacggatcagaaatcgccaaggatgtttatgtgacggatttagtgatccaatagaaagaggcgtgttgatggaaacatttttatcgctggtcaaaatgattgggtttttgctgcttattctttatttgatcaacatcagtttgaaatatttaaatcgttacacgaaccagcacaatcaccagttgcgtattttacaaaaaatcgccgtcagcaagtcgtcttcgatcgggatcgtccaaatcatggacaaatgttatgtcatgagcttttctgaacagcaaaatcagatcatcaaagagttgacgccagaagaaacggccgcttttttacagcaaagcctagaaaacacccaagtgcaagctggcaaagatttttctgaatggctcaacaaagccaaggcggaaattgctggaaaacgaggcaagcaaaaatgaagattaaaggcagagatatcaagatcatggctgcggtccttttcagcagtttgatgcttccgcagacggcgtttgcgctcgacacggaagacgtcagctccaccatcaacaatttattgtcgaatgggaatggctcaagtgatacgatcaataccttcttgttgctgacgctgctttccctcttaccggtcttgctgatcatgatgacctcttttactcgtatcatcatggtcttgtcctttgtgcgcagttcgttaggtacacagcaaaacccgcccaatcaagtattgatcgggttggccttattcttgacattttttattatgaaacctgtgtataccgacatctaccagcaagcgatcgaaccgtttgatcgacaagagatcagccaagccgaagcttttgaccgctcagaaaaacgaatcaaggcctttatgatggtacagacacgggaaaaagacattgccttgtttgcggaagctgatggggagaccgaaaagtatcattcttctgacgatgttcctctgaccgttatggtaccggcttttattatcagtgaattacgaacggctttcagtattggctttttgatttttatcccctttttgatcattgatctggtcgtctccagtatcttgatgtcgatggggatgatgatgctgtcgccgatcatgatctcactccccttcaagatcttactatttgttttagtggatggctggtatctgatcgtggagtcgctgatcaagagttttcaatagccgctaagaaaggagccaagaggaaatgacagtagaaatggtacttgatgtgctaagggaagcctttcttcgaattttagcgatatctggccctgccttattggtcggcatgctcgttggattggtgatcagtatttttcaagccactacccaaatccaagaacaaacgttgagctttgtgccgaaactattagcgatttttttgaccttgattttggccgggaattttatgctgaatctcttgttgaattttaccaaaatgatcttcaagatgatttcagcaatgtaaggaggaaacctgatggcgccgattcaagcgacggtgttgattttttgtcgattattggcgtttgtcgtcctttgtccgatcttctcacagcaaaattttccgtcactggcaaaaatcgtgatcggcatggcgttgacggtcctatgtctgccgacggcacctgcgattcccgagctttccctctttatgatgacggttttcgtcatcaaagaagtactgtttgggatggcgatgggctatttgagtcagctggtctttaccggtgtggaaattgcgggccaattgatcgactttcaagtgggtttttcgatggcgcaagcctatgatccgacgttgcaaatcgcctcttcccagtatggcaaaacgtactattggctgacgatcgctgtgttttttggacttgatctgcatcatcgactgattacagcactgctgttgtcttttcggatcgtgcccttaggctctgtggtgatccaaggcacgacggttgaaggcatcgtcaaacttttcagccaaatgatggtgatggcagtcaatcttgcagcaccaatgatcattgcgctgctgttggtggacctcgtgctaggtgtgatttctcggtcgattccccagatcaatattttgatgatgagtctttcgatgaaaaccgccatcagttttgtggtgtttctcttgctattacccaatgtcctttcgtacttaggcaaacacttgccagatacggtccgctacttgcaggagtttatcaagtcttttcaataaagtaacaggcagccagcaggaggtgagaagatggcagaaaaagatggcaaaaccgaactacccagtgccaagcggctgcgggatgcccgcaaacgcggggaggtacctaagacccaggaattagcagctgctgtttcgctactggtcttctcgtttttgactctgtctttatggcagtttttcgccgcttcttttttgccttatttttcccgaagtttggcgcagctggctgattatcaatccagtttggcggatctgccgaaactgggggtgcagagtatcttgctgctgcttttgttgtgtgcgcccgtctttctggtcgcgctcggagtcgggcttattacgaattatgcccaagtcggtctgttgttttcaggaaaggccgtcaaaccagactttaaaaagctgaaccctatcagcgggatcaagcagcaattcagtttgcgctcgttgatgaatttaggcaaaacattggcaaaattcggcgtgatcgtctacttgtgctatcaacaatttttagccgccgtccctgttttactgggtttgagtgaagtggggttggaaaaaacgatcctgttcatgctgctgcgggccaaagaattgttcttacagatctcgattttcttgatcattttggccgtagtcgactacggctaccaacgctatagccatcgcaagaacttgatgatgagcaaacaggaagtcaaagaagagttcaagcaaatggaaggtgatccgcaagtcaaagcacagcgcaaagcgaaataccgtgcgatgacccaaaatgccatcgccaacgtcaaagaagcgacggttttgatcaccaatccgacccatttcgccattgcgattcgttacgatgccagcagtgaaggggtgccacgggtcttggccaaaggggcagatcagctggcgcagcggatgaaagcagaagcactgaaagaaaatatcccacaaatcgaaaaccgtgaagtagcacgggccctttaccgtcaagtagaacccggggatctcatccctgttgaaatgtatgaagccattgctgaaatcatcgctttggtctatcagctagaagaaagccaacgcggcaagatttaaggaaacaggaggaactaaaatgaatgaggctgcctcaaaaccgaaaaaaggcattggtctggcggatatcttaatctcggtgatcgtcctagctattattggtttgattattattccattaccgagtgcattattagatattctgatcattatcaatttgacgatcgcgatcaacattttactgatcaccctgtttaccaaatcagtgttggaattcactacgtttccaaccttgctactgatcacaacgatgtttcgtttaggcttgaatctatcttccactcgtttgatcttgacccaaggaaatggcggacacgtgatcgatgccttcgccaatgtcgttgccggcagcaattacatcgtggggatcattttgttcgtaatcatcatggtggttcagctagtcgtcgtgaccaatggtgcagggcgtgtctccgaagtgactgctcgattcacattggatgcgatgcccggcaagcaaatggcgatcgattccgacctaaatgctggtttgatcacggaagcggatgcccgcaaacgacgaaaagatctgcagcgagaagctgatttctttggttcgatggatggtgccagcaagtttgtcaaaggggatgcgatcgcagggatcttaatcactgtcatcaatttagtcggcggagcgatcattttctccatggggggacaaatgaccgtcatggaagccttcgcccaattcgggaaactggcgatcggggatggcttggtcagctcgattccctctttactgatttcgattgcttccggggtaatcgtgactcgttccgataacgatagttcctttggtttggatattgcggcagatgtgatgcgtaatccccaactgtttcggatcgtgggggcgattctcttcgtcttagccttagttcccgggtttccttttgttccttttgtgttgattggtttaggccttttcgcagccagctttctggttacgcaaaaagaagaaaagcagcgagtggaacaaaaacaatgggaacaaaaattggcactagaacgcaaaaaagaagcgcaggaagaagatgattccgtggcttctttccaagtggaaccaatctcagtggaaatcggttatggtctaatccctatcgtggatagttcggtcgacaacagcttaatgaaccgcattgtggcgatccgtaaacagagtgccagagaattagggatcttagtcagtcccgttcgtattcgcgacaacctctatttggatgccaatgattacgtgatcaagattcgtggcaacgaagtcggccgcggcgatatttacccgaacaaagtcatggtgatcagcccgaatgaagagccgtttccttttcaaggaatcgcaacaaaagaaccagcctttcatctggatgcaatgtggatcgatgaatccgataaggagatggcggatctgcaagggtttacgattatcgagcctttgactgtgatcgcaacacacttaaaagaaatcatctatgcccatgcaccagagctgttaggtcgccaagaagtcaagaaattattggagggcatcaaagagcagtacaatgtcgtgatcgatgaattgatccccgatattttgcggctcggcgaggtccaaaaagttttacaaaatttattggatgaacaaattcctatcaatgacttagcaacgatcttagaaaccttagccgattacggcgttgtcacgaaagacgtagaagttttgacagaatatgtccgccaagcattgaaacggacgatcgctgccaagtatgccaatgaacgacacgagctgcaagtggcggtgatccagccgaaactagaagaaatcatcgctcaaagtatccaaaaaaccgcaactggctcgtacccggtcttaaaaccagataccgtgaccaagctgttggattccatcagtgggatccaacatgcggcgattgctcaaaatatcaatttcgtcattctggcatcgcctaagatccggttagcattcaaaaaaatgattgtttttaatttcccagatatcgccgttctttctctaaatgagattcccaatgaaattgcgatcgaaacggtgggcagtattgacatttaagcagaattttcttaggaaggggcatcgccgatgtatgaagtcgatcgagaagcggagatcatcaagtatctgccgctagtggaacgggtggttcagcgcctgtctatcaaaaccgccgattatgaatcaggtgatctctacaatattggggtgattgggctgatggatgccttgcggaaattcgatccctcaaaaaaagttccttttgaaagctatgcagtgattcgcatcaaaggggcaattattgatgaagtacgcaagcacgccaaaatctcccgttacaaaatggcggcagtcaatcagttttatcaagcacggcaagagttggagcaaagcctcaaaagagaagcgaccgatactgagatctgcaaacagctgggaatcaaccaaagtcaactagcggatatttatgagagtttgcactacttagccagcgtctctttggaagataccttgtttgcttaccaagaagaaggcatgacgataaaggatatggttcgggatcctgccgagaatgtcgaagataccttagtcgctgaagaaaaacgcaccgctttggttgcgtgcatcaaaaaattaggggaacgggaacaaataattttaagtctgtactataccgaagaactgacgttaaaagaaatcgctgaaatcttagaaatttcaattccgcgggtctcacaaattcacggcaaaacgattgccaaattgcgcacattgattgaggaggaactggcatgattcgaggattggatgtcttatcacggaacatttcattattacaaaagcgacaagagacgacgagcggcaatattgccaatgtcaatacaacagggtatcaagcaaaagccttgtttcagtcggcactagatgaagtggcgctgcataattatcaaagcgggcccaatgcggatactcgccgcgatatcggtgggttgtctttagggacgcaactggcaggtagtacgatcagccaagaccaaggcgccgtcaaacagacgggacacgccagcgattttgcactgctttccgaaggctactttgtcgttcaaaacaatgcgggtcagcggttgtatacgagaaatggcgactttaccgtcaatcagcagaatcaatacgtaacacaagaaggctatcttgtcttgggtgccaatggacaagcagtcagcgccttgggaccagcgaactttcagatccaatcatttcccccagaagcactgactacagatggtcaaaactacgtgactagcaacgcagcaggaaccaatgtgaatgcaccagtaatccagcaaggtgccttagaacaagccaatgtatccgttgccgatgaaatggtggcgatgatccagacttctcgggaatttgaagccaatcagaaagtcttgagttcaacgaatcagacattgcaaaaagcggtcaacgaattaggaaagatttgaggatgagtcaatgaatatcagtggattactaggaatcagccgttctgggttgaatcatttgcagacaaacttagacacgacagccaacaatatcgccaacgtcaataccaatggctaccaagcacaaacgacgcactttcaagcattgatggaaaatgccatcggtgcagaagaaacgctgtttaatggcaacaccgcccaatatggtgcgtcaatgggggcgaaggcaaccacgaccacaagttttgcccaaggcaatctggcgggcactgctcagccattagatctcgcaatccaaggcaatggctttttcggggttcgggaccaaaccggtcaattgctgctgagtcgagcaggcaattttcatttaagtgagaacaagcaattagtcaatagtgaagggtaccctgtggcaatgaccacaaacgtaccgacccctcagtggccggatgcgcagcaaatcgcaatagatgccagcggtcagttgacgacggaagaaaatggtcagactcgagtgttgggacagctgaccctttatcagccgacgaatacagaaaacatcacgccagtgggcaaccaactgtacagtgccggtgatcaagcgttgcttacttcgcaaaccaatccggcagcctttggcagcgtcttgcaaggacagttagtacagtcgacggtggatctagcgacttccatgacagacttgttaacgacccagcgtgcgtatggactgaatacgaaagccatgcagacagccgatgagatgtggtccgtgatcaatcgttttacagattagaggagaaagaacatgattcgcttaaccaaggtcagtaaaaaattcagcaatggcacgttggcattggccgatatttctgttgcgatccctcaaggagaatttatctatgtggtgggtcccagcggtgccggcaaatcaacgttattcaaattgctcttgaaagaagaagaactttcggccggttctatccaagtcggcaatgtcttgttggaacaactcaaagaccgtcatctctatatgattcggcgacaagtcggtatcgtcggacaagaagaccttttgcttccttatctgacggttgccaaaaacgtcgactatgcgctgcaagtactaggcactccccgcaagctgcgccaggaaaaaaccgccaaagcgctgcaactggttggcatgtttcctcaaaaggatcattatcccgaagagctttcagtgggacagcgcaaaaaagtagcaatcgcgcgagcgatcgtcacagatccagcagtcttgattgccgatgagcccaccgccaatctggatgcgaaatcagccgtcgaagttatgaaactgctcttgcggatcaatcaagtcggtgccacgatcctattggcgacccatgacagtacgatggtcaatacggtccgtaatcgggtagtcgagctgcaaaacggtcgtttggttcgtgatgaataccaaggcggctatactcgctttgctgatccaaaagatacatatgtctggtgaagatgcttaacttttctagcaaaagatccgattaaagaactagaagattgttttcataatcggataaagaaggagtgacccaacgattatcaagtgaagagcgaatcttgataaacagcacgactgatcattttgcataagaaaggatactgttatgaagaagaaggtacaagctatcatcaaaaaaatccgcttagcggtgttgattccgctaggatttaccctgatcgtattattaggatgctatttcttcgtgatccgcacccacggagacggacaagcagcaaaaagtttctttattttttcagtgatcgtactgctactagaaattgcagtgttagtaggaatgacctatctagcaaaaaaagagacccattcaggcatggatacgttgttggcagaactagaagcagtcggttctggcgatctatcccatatcgatgagatcggcagcagcgaccaaatctccctttttgggcaagttcaaaatcgttttcaaggggttttaaacaccttcaaagcggtgatcgttggcatgcatgaagaaagtagccggatggaaaaaatggtaggcggtctaacgacaacctcaaaaaatgccaaaaattcaattgaaaatgtgcgtcagacgatgaacgccatcgcagatgctactagttcacaagcctccgaagcggaacaaacctcctttgatatggacgaattagccttaagtatcgaagagatccacaaagagatcgaattgatgaacgggtatgtcggtcaatcccaaagcagtaatgtccacaattcagaaatgatgttccatgtgtttgaaagttgggagatcgaacggcaaaaccaagcagaattagtggaaagcatgaacgacatgaatgaagatgtccaaagtatcggaaaaattgttcagctgatcaatgatatttctgaccagaccaacttactggcattgaatgcatccatcgaagcagctcgggccggggaagcgggccgggggtttgccattgttgcagaagaagtccgcagtttagcggaacaaagcagtcaatcaacgaagagcattcgttcgatcattgaaacgatccgcaaaaaatcggaaaaagtggtctctgcagtgacggattcctttgaaagcggcgaaagacagaccaacaatattaacaaagccatcgagtccgctaatgagatctctgacattgtcgaaaaattggtttcaagtatccaaacagttgaatcccatattatcgggatcgttgaaaaaaaagacatggttcatgtttctgtcagcaatatttctgctgccgtttctgagacctctgctgggacgcaagaagtaaccgcaaacctagaggacttctacttggtcatcgaaaattttgaacagaatgtacaagaaattgagacaatcgctaatattcttaaattccaagtggatagtttcaaattctaaaaaggagcggtgacgctaatggaacaatacgttgtatttaaaagtcatcaacaacactttgccttgcggatcgattatgtggtaagggtcattgaggctgcctctttcacacagctgccagaagtggcggattttgttctgggtattcaacccattgaagaggcgatggttccgatcattgacatccgcaaaaagctgtttgatgaatttacgccggaaaccggacaaaatgtggtcttgttgtgtcactggcaagaacaggcgatcggtctttacgtggaagagatcgtcggcattctacccttagccgaaagtcccagcaatgcggaattaaatacgtcaggacttaagcaaaactatatcgaagcctttctgaaaaaagatgatgaacttgtactggcattggagctgccgtttctcttcagctatgaacaagcggcagagatgaaggatgagttaggcgcctatcagacagagaaattggcagccgccaatgacgatgacaatgatgaccgtgaatgaggaactgcatgtggggatctcggagtataagatcgcccaagcgccaactcgtttgatcacggtgggcttaggttcttgcatcggcacgatcatttacgacgaagccagtcatattggcggcttgagtcatattatgctgccagatagtcagccttttttgcacaagcgggaaatcaagcccgagaagtttgcggacttggcattgccggcgatggtcgccgagttgaaactaaagatccgccggcctcgctttcaagcgaaaatcgttggcggcgccaatatgtttcagttccagacccttaatgctgccagcaatattggtcagcgtaacattgaagccgtcgaggaagtcttggatcagctaaacattccgatcgtggccaaacatgtgggcggcagcgctggtcgaaccatggtcgtagaccttcaggatttcaaaaccatggttcggcaagtcaaacaagaaatcgtttatttgtaaaaggagtacagggatatgaaaaaagtaatgatcgtcgatgattcggcattcatgcggaaagtagtgacagatttattgaatcagttgccggatatcgaggtgaccgtcgctgcccgcaatggcaaacaagcattggattatttgaccaaagaagcgatcgatttggtggtaatggatgtggagatgccagtgatgaacggattagagaccttgcggaagatgaaacagcaatcagccattccggtcatcatgcttagctcattaaccaaccaagaaaccacgattgaggcgttagcgcttggcgcacgagattttgtcgaaaaaccagtcagtctatcgatgatcgaaaaagaatggatcgctgaatttcatcaaaagattttagcgatggatcatgaagccggcacagctcaagcactggtgccaacggctgcccaacccactaagctgacgcaaaacagcttgtcgtctcatcttgacgctctggtcattggcgcttcaacaggcggcccgcgtgccttactgggcattatccgtcgcttgcccgcgcatctgcgctgcccaattttgatcgttcaacatatgccagcgggatttacggcttcctttgcgaagcgattagacacagagacaaccgtccgagtacaagaagcaatcgacggcatgcggattgaaaatcaagtgtatctttgcccgggggattaccacatgacgatccaacaaggacatttgcaactggaccagcgagaaaaacggcatgggacgcgcccaaccgtcgattatcttttttcctcagcagccgattactatggtgcgcaactagcggcggtcgttttaacggggatggggaaagacggcaccgctggtttacgacagatccaaacggctgggggctatacgatcgttcaagacaaagaaacgtgtacagtttttgggatgccgcggtatgccattgaacaaggagtcgttgatgaagtcctgccattgcaggatattgaagcaaaaattgcacagatggtcgggtgaagaagatggaagaagaatttgccttatttaatgcatgggtggatcgccggttagggattccattagccgcatacaaagaaaatcaaatgcagcgccgcatccttacgatcatggaaaacagcggggcaaaaacgttgagggaataccagcaattgatcgaaggagatgaaggggtgcgggcagcttttttagcccatatcaccattaacgtaacggaattttaccgcaacaaagaactatttgacgcctttgaacgcatcttgaaaaccattgttctcccgaaaaccacgctgccaaaaatttggagtgccgcatgttcgattggggcagaaccctatacgatcgctatgctgctagaaaaaaaccaaattgctgcagccaatgtcttggccaccgatatcgatatgcaaattttggcaaaagccaagcaaggactctatcgagagcacgaattgcggaatgtctcagcggcagaacgtacccgtttttttgatgcaatagaaaagaaccagtttcagatcaagacagaaatcaaacggcgggttcattttaagcaacacgatcttttgaaagacccgtacaatggaccttttgatgtgatcgtttgtcgcaatgtgacgatctatttcaaaagtgacgctcgggatgccgtctatcaaaaattcagtgatgcattggtcccagggggcattttgtttacgggagcgacagaaacgatcaatttcgcggaacaattcggtctcaagaaaatcgattcgtttatctatcaaaaagtataattttgtaaaggagggacccatttggatgacaatagtgtctatcgtacccttttctttgaagaaacagacgatcatttagcacagttgaatgatcatgtcttgcaattggaaaacgatccacaagacagcgccttgctgaatgatattttccgttctgcccatacccttaaagggatggcggcaacgatgggctatgacgtcatgacgcagctgacccataaaatggaaaatatttttgagttgtttaaaacagggaccttgcaagtgacccagcaatcgatctcattgattttcaaatgtttggatcgcttgtcagaacttgtggaggatctgcgggaagaacgtgacctgcagccagctcaaattgccgatttattggccgaacttgaccaaacggaacattctggcggcctaccaaccgagacagaagcaagtcaaaaacctacagcagcgggcgcattaaacccacagtttcaacagatcgatccttctgatctgtacgtgatcgagcaagcggctggagatggctatcaagccgttcaaattgctgttcgcttagatgcccaatccatgttaaaaggcgctcgtgcctttttgatcatggaaaagcttggtcaaacaggggatgttctctatgcagaaccagatgcccaaacactcgaagaaggcacctttgaatcggatttctcgctgctgtatttgacacagcagacactagctgatgttgagcaaaacatcgccagcaatagtgagatcgaagccttcgtggtggcaccttttgatccatcagccgctgtgttggaagaggcagaagagctgcttcagccagcgtcggcccaagagtcagaaactcctgctctccaacaagcgaaaacagaaacgaaagaaaaatcaccggcgctagcacatcatgcgtctgcccaaaatcaatcaatccgagtcgacttgaatcgcttagattcattcttggatctcgtatccgaattggtggtctatcgcaatcaattagaagatgtcagtgagcgggaaaacatcgaagcagtcaaagaccccttagaacaagtttcacgattgacttctgagctgcaagatttggtcttgcggatccgcatgcagcaagtcaatgtcgtcttcagccgctttccaagaatggttagggacttatccaatgaactgcaaaaagaaatggaacttgtcatttttggggaagaaacggaattggataaaacagtggtttctgagttgagcgaacccctggtccatctgttgcgtaattctgccgatcacggcatcgaagcacccaacgttcgggaaaaactgggcaaacctcgcaagggcacgattcgtttggcggcctaccaagaaggtaatcgcgtgatcattacattagaggatgatggcaaaggccttgatccacaagtaatcaaagcaagtgctgaaaagaaaggcttagccacggcaggcctttccgatgaagcgttgcagcagctgatcttccaccccggtttttcaacagcccaagaagtgaccaatatttctgggcgcggtgtcgggatggatgccgtgcaatcgaagattacccaactagggggaactatcgagatgaagagtcagccgaataaaggcacgcagtttgtgatcaaattgccattgaccctgtcgatcattcaagcattgatggttcgcgtcggcgaagaaacctttgcgatcccattaaatctagtcgaacgcgtggtgatgatcaaagaagaagagatcattcagacggtctcagatgaggtctatcgttttcaagaagagttgattccgttgattcggaccgatcaactcttagcgatcgaaggcgacctatctgagaaaaaattcgcaattatcgtcaacaatgaccaacaatttcacggtattttggcagatgaattgatcggccaacaagagatcgtcatcaagaaaatcgatccgctgctgcaaaagctgaatcgctatcaaggagcaacgattatgggtaacggctcgatcgcactgatcttagacattcatgcgatctgtcagaaaaaaaaggatgaccgcttatgagttatacagcgctgcagatcgatggactaaaagaactgatcaatatcggcggtggccacgctgcgactagtttatcaaagctcctccaacaaccgatcgatatgcgggtaccggaagtcgagattctagcttatgaggatttgtatcagcagatcatggcggaagacaaagaagtacatgtggtgataagtcaaatcgaaggggcgtttcgggggatcttcttgtttgtcttaacggatgaatccgccgcaaaattgcgtcagttgatgatccaagaaagcgatccgtcagaagagttgaagcaatcagtcatcaatgagttgaccaacatcctcaccaattcttttttgatcgcgatcgggcaactgttggaaacacagctgagtgcgtctttaccaagtgccagctatgatttctttggcgcagcgatcagttccatctatttggcaatggcccagtatgatgagcaggtgatggtaatccgtaatgagttcgtctatgccaaagaaacattagaggcatcgttatttttgattccagaaatcggtgtactagaaaacatatttgattcattaggaatttgaaaggggcaaatacaatgtcaaaaaaagtattgatcgtggatgatgcggtatttatgcgcatgaaattaaaggatattttagaaaaaaacggctatgaagtcgtgggggaagcccaaaatggccaagaggcttttgaaaaataccaagcaacgacaccggacttagtgaccatggatatcacgatgccggaagtggacggcttagaggcgttaaaaatgatccgcacgtttgatgcgcaggcgaaagtcgtgatgtgcagtgccatgggacaacaaggaatggtgatggatgcaattcgcgccggtgcggtggactttatcgtgaagccctttgacacggaccgcgtaatcactgccattgataaagcctttgcctaatgcctaggaggatagcgacatgcagatgatacttttcaaaatggcccagcagtactatttgatttcggcggactcggtggacgaggtcattgatgctccttcctttacgaaggtgcccttagcacctgagtgggtagaagggttgatcaacctgcgggggtctgtcgtaacggtgattcgtttggcaaaactgattccgattatggaaccagcctacgaaaaaaatatattgatcatgaagaagcaagaggaaaccaaaggggtcctcgtagaagaagtaattgaagttcttgatatcaccgaagaggatatccaactagacaatcaagagacagaacatgccgttggagtcgtgacgatcggtgaaaaagtagccagtgtgattcaaatcgatcacatgattttttaaaaaaaatgggggattagtgtggatcaggtattgacgcagcaagagattgatttattgttgaatgcgatgagcagcggagagatcgatcaagaaattattgagatagaagacaaacaagccaaagtgaaagcctacgattttcgccgaccaacaaagctgtcgaaagagtacgtcaataccctgcacatgatcttcgaggatttctcgaagatgagcagcagcatgctttctacccaactgcggaccaatgtttctttgcagttggcagctatcgaacaagtcagttatgacgaatttatccattcgataccaaaatttactttattggggctctttcattcgcagcctttgagcgggatccagatgatcgagatgaacccacaactgtgcatgatgttggtagaattgttgtgcggcggtttagatgtttatcaaaacaagccgatcgaaatggattttagcgagaaaaaaagttttactgatattgaaacagcgatcttggaagaagtggtggcacaatttgtacgggtctaccaaaatgtttggaaggacatcgttgccttggattcggttttggatggaatcgatacgaatccgcaattgatgcaaaacatgtcgccgaacgaacccgtcgtattagtgacctttactatcaaaatttttgaagtgaaacatttcatcaatctatgtatcccgtacgtcttctttgaagggatcattgataaattaagtttccgcaattggtttgatagcaatcagccagtcaaccaagacgatagccgcgagttgcaaaaaagtttgaatggggtcggcttgaatttagaagttctgctgggccatgctcaaatgagtctttctgagtttctccacctagaagaaggcgatgtcatcaaactagacaaaaaaattactgaaccattagagaccttcatcgatggaaaaccttacttccgggcaaaacctgggaagcaagaggaccgtttagccattgagttattagacaagttagaagaggagcaaaaactatgagtgaacgtttatcccaagcagaaatcgatgcattgttgaatcaaagtgccccagcccagccgcaaggattagaagagcaagtcaaagtcgacattattggcgaagttggaaatatctccatgtcgcaagcggcgacgacgttgtcttccattcttgatcttcgggtcagtatcacgactccccgggtgtctaaaatcaaatttggtgagatcttaaacgacctcgttgcaccaaaagtagcaacgacagttgaatttaaagaaggccttttaggcagtaatttgatgctgttagaagtcaaagatgccatcgtgatcgctgatttgatgatggggggaactggtgaacccaccaacacccaatttacggaattagagctaagcgccgtggcagaagccatgaaccaaatgattgggactgcctcgacttcgatggcgacgatgatcagccgcaaagtggatatcttgccgccgatcgtcaaactatgggagacaccagaaaacattgagtatagcgggatcgaggcagaggaagagatttactgtatctcattttctttgcgcgtcgaaggtctgatcgaaagcaaaatcatgcagatctttacggatcctgtggtcaacgatatcgccagtgcgatgctgtccgatgaagcgactgtcgttactcgggaaacaccaacaccgcagccaacagcacccgttgctgcacctaagccagaaccagaggctgcatcaaagcccgtggaggtcagcaaaccggcatttcaaacattggcctccagcggagtgaacgatggggataatttggacttgatccttgatgtgccattggatctaagtgtcgtgttaggccgcagcaaaaaaaccattaaggacattttatctttcaatacgggctccgtcatcgagctggaaaaactgacggatgaaccgctagagattttgttgaacggcaaactgatcgccactggggaagtcgtggtcatcaatgaaaacttcggcgtacggatcaccaacattctttcgcaaaaacaacgcattcacaatttgcattaacttgaagaaatcgcaaaaagttaaacatatgggtttaacttttttgtgatttgaccgatagtagagggtagaagaatgagaacggaggagaacctatgaaaatcgaaagaggttacgcagaatacagcgacaaggccatcaaacgcgatgcggtcaaacaagaaaagccaactgctcctcagacagaaaaaaccgtcgatgttcaattgtccgaaacagctcaagccattcaaaagagtgccaatcaaacagccagtcgcagtgagcgagtggcagaattgaaacgagcgatcaaagaaggcacctaccaagtatctgccgaaacgatcgccgataaaatgctgcagcaagatgaaaagcaggtcgactagatgacagagcgggaatttgagcgtcagcttcagcagttcttgcggttgctgcaaaaagaaaagacctgcttgatcaaaaatcaagcagaaaaattaccagaactcgtcgagaaaaaaaccgccttcgtacccgttttttccatgtatgaaggaactctttcagcggcgatcaaagaactcatccgccagatccaagtgcagcaagccgagaatctcctgctgacggaacaagccattagtttccaaaccgttttgatggatgcagtcaaagaaaatatcaagacaccagcaaatacgtattcgaaataccaagaaaaacaagttgtctcaacagcgatcatcgatcaaaaaatgtaaggagtacttctatgacaggactatttggttcattaggcaccgcaacccggggcatgaccgccaatcaagcagcgttgcaaaccagcagccacaacattgcaaataccaatacagacggctactcaagacaacgagtcaacttgcaagccgaagcgtcttatcatttagcgggcgtcggcagcatcggtatgggtgtgaaagtcggcagtgtcgaacggatcgtcgatgattttgtcattggacaagtacgcaatgccaattctacctatacatattacgaacaaaaagcagacatattaggacagctggaaagtttaatgaatgagccttctgacaatggactgtccaaacagctggcaacgatgtttgattcttggaccgcattagccaacaatcctgaactggatacgtctaagaccctcgtgctggaaaacagcagtacgtttgccgataccatcaaccaaatgggcaaacaaatgacgcagttgcaaagcgatacgctggataccatcgaaaaatccgcgctggacttcaatgagaaggtcaaacagctgcaatccttgaatgaacagatctatgggttgacgacgagtggtgaaacacccaatgatctcttagatcgtcgagacagtctgttgaaagatctctcgggtctagcagggatcgaaaccaagaccgatcaatatggccgtgggtttgtatccatgagcggacagacgattttaagtgctgaggaacgcaatacccttagtgtggtggtgggacaaagcgacacaggcgccttggtttccaaagacggcaacgccttgaatcctgctgaaaccattacaggatcttatccagctggaaccatcttgttgacgaaaaccaccgacaatggcgacaccgcctatacagaattgccgatcaaagaaggcgcaatcggcggcctgcaagcatcatctggtgagatcggcagccgcttgacggaattgaacaactttacgacgacgatcgcgcaagccatgaacatggtctttaccagcggcgcttctcgtactagcggtctatttgagatcggccaagatgatactggtacagccacgacgattcgggtcagccaagcactgttagataacccaagtctggtggccggcggaacgagcaatgcagcaggagatggttcaagagccgctgcaatggcgaaactcagcagtgccaaattggatttcccattgtcagaaaagacgatcgcttcttttgatcctgagacattgacgtttgctaatgcagcatccggaatgagtgtcagcagctattttaacagtatcgttaccaaaaacgggatctcaaaacagcaagccgacaatacggtcagtgctcaattgtcactgctgaatcaactagaatacaaaaatcaatcggtgtccggggtttcattaaatgaagaaatgtcagatgtgattcgtttccaacaaggatttcaggccaatgcccgcgtattatcggtcgtttctgaaatgttagacacattgatcaatcgaacaggagtgtagaccatgcgtatttccaattcaatcacctacaatgattttttacgaaatctaggaaccaacgcctccaaagtccaatccacgttgaatcagctatcgagcttgaaagaagtcagcaagtcctcggataatccactgctggtttcaaaaatcatggatcttaatgtgtcgttaaatcaaaacaaaacttacaacaatacgatcaaagacagtatttcttggacaaaagctcaagattctgctttagaaagtgttagtacctcgatgctgcggattcgctcgttggttcaatcttctgccaatgcaacagccggcagtgaggaattaggcgcaaatcgttcagagatcgagcaagagatcgaaggcatcgtggaatcattaaataccaactttgatggtcgctatctatttagcggaacgaatacgacgacggcgccttttgagatcgtcaaaaaaaatgacgccatcgtcggtatcaaatacaatggctctagcgaagacttgccccgagaaatcgcaaacggggtctcggtggatctgttagccagcggtgatcgtctgatgaacgagacgggtacagctgcggatccccaaaatttaagcacctacttcaatgatttattgtctgcgttgcgcagtgatgataaagatgcattagggggcgagcttttaaccgctcatgaccagcatgccactaatgtggtgaatgtacgggcgcagatcggcactctctacaatcgcttggaggcagcagctgatcgaaacgagacggaaaagctgaacttgaccgaaacactgtccaacaaacaagacgtcgatattgcggaaaagtatatggaatatcaaaatcaaatgactgcctatcgttcaacactagcgatgggaacaaaaatcatgcagatgtccattctagattacttaaattaacccgaaaacttttgttctttgctgagagcaaaagttttttatttttttttagaaaaaaggcttaatcctgaatggtttcttccgataaatagtagcagagggaaaccttagcgaataaaaattaggaggaactacacatgagaatcaatacaaacgtttcagcattgaatacttactcacgcctaacggcagccaacgcttctaaaagcaattctttgtctaaattatcttcaggcttacgcatcaacaaagctggggacgatgcagctggcttagcaatttctgaaaaaatgaaaggccaaatcggcggtttgtcacaagcaaaaagcaacgcacaagatggtatctcattgatccaaacagcagaaggtgcattaaatgaaacccacagcatcttagggcgtatgcgtgatcttgcggtacaaagttcaaacggtacgttaagtgatgacgaccgcagtgcgatcaacaaagaatacaccgcattgtctgatgaaatcgaccgtatcagggataccactgaattcaatacaaaaagcttgttaactggtgaaggcgatgatgcgaaatcattcactttccaaatcggtgccaacgcaaaccaaacaatgagcgtttcaatcacaaacatgagctcaactgccttgaaagtaaaaggcttagatttaacacaagcatttgccacaagcgatattgctgcagcaaaagataaagcagtagcggctgccttcaaagcagatacaacaacaaaatatgcagcggacggcaaagttgatgcggcagctggtaaaacagttgccgatttacaaacagccatcgatacagcagcggatgatgcagcaaaagcaacagctcaaaaaacatacgatgatgctttagcaacatttaccgcttctgatgaaggcaaagcagcagcagcagcagcggaaactgccatcgttgaaaacaacccaatcacaaaaatcgataaagcgatcaaagcagtttctgcacaacgtgcggatcttggtgcggcgcaaaaccgtctagaacacacaatcaacaacttaggtacaacgcaagaaaacctatctgaagcaaactcacgtatccgtgacgttgatatggcgcaagaaatgatgagctttacgaagagcaacatcctttctcaagcagcaacttcaatgttggcacaagcaaactcaatgcctaatagtgtattaagcttgttacaaggataattttttgatcagaggaactactgacacaaggactgcctaggggaagcacagttcttgtgttttacatagcagcacaaaaacgcttagaaatgaggaagctctgatggatattcagccaatttcaggaatacacccgatcgaagccgttgcgtcggtcgctaagacacggccgattgaagccgtagatcaagaggccaccaaccttcgctcgcaaagcaaagggcgtggattaacagaggaaaaggaacggacagtggcaactgaaccgccgatccactatttttcagcagccgatcagcacaagatcggagtctccgtggatgaagtgaatcagctgctactgggcaaagatatgaaattggcttatgaagtgcatgagcgcacggggcggacgatggtgcgtttggtggatatgcagaccaacgaagtcatcaaagagatcccacccgccaacatgctagatgtgattggaaaaatatgggatgacatggggatcgcggtcgatcgaaagggatgaaaatatggcaagtgtaaccagcagttcaggaatcagtacaacgctagggagttattctggcgtgacttcagaagatattgaaaaattattggcggcagatgcgatcaataagacccgcgctgagaacaaaatcacgtcgcttaaagcacaaaaaacggcgtggagtgatatcagcactcgcctgacgaactttttgtcaaaagtcgatgcattacaaaaagatgatgcttatcaaacgaaaaaagcgacgaccaccaatagcagtatcgcttcaattgcaggaacaacggaagccccagaaggtacctatgatttaaaaatcaaccaactagcaacagccacgaaggtgacggggagtcaagtagctcaaagcagcaaaacagctctaaatgtcagtggtcagctgtcattgaccagttcggaagtagatgaaaatggcaaaccgatcaccgcttcgatcgagatcactgctgaagacagcttaaaagatgtggcagctaagattaatagccaaagcaagacgaccttcgttgcggcgagtatcgtggataaccgcttgattttaacgaataccaaaatgggcgacaaaaatttcttgatcgacggcaatgccgccgaagggttagggatcggttcaactgcgacaacgacgcaaggccaaccggctatttttgagctagacggcatgaagatcactcgcgacagtaacagtgtgacggatgttatcgatggtgtcactctgacattagctaaaaaaagcgaggagcatgtgacgctttctttagccaatgatacctcgaaagtcgttgatgcagtgcaaggattagtggatcaatacaatagcttgatgagttttatcgatgataatttgaccgtgggagatcctagtagtgaaaacaacaagacggggaccttggtgggagacagtgcgttgacccgtctacagactcaattgcgaaatttgatcaccattccagccgtcagcggctcaaagctgaccgctagtaagctaggcatctccaccgtcgataatgatggtacattgggactggatacgacaaagttaaaagaagccctagcggaagatcccgctgctgtgaagtccttcttttatgcaagtacgaaaatcaaagaagccgatggcactgcgagtacgaaagagaccggctatacactagcgctaaaagaattagccaacagctatgtcgtcaatacttcagccaataaagggatcattgccaccaaatctgcgacctatgacagtaccatcaaggatttaaacaagcagatcacacggtttgatgatatattagcaatgaaaaaagagcgttacatcacaatgttcaccaaattagactccgtgatgatggaggctgaaaatcagctgagttacctaagcaatcagtttgccaatacgtcaaactaggcaagatatacgattaaagcagtcattttttcattcgcataagaaaccctcgtcaacaagaaaggaaacaatctatggagccacacgtatcattagatgaacgtttgaatcagatcttaactagttttgcaaaatggcatggcgacagcgaagaagccggtcgtttgatggcagccaatgcagtggtcatagaagccatgcaggcagaagaacagagccatagtccccaaaccagtgtattggcgcaacaagtgatccaagcgtatcaagtgttcttagaccaggtcaaagcccagcagcaagagatcaaacaagaattaggacgtttgaaccgcaaaaataatcttgtcaaaacgtatttgcagcaagaagacaatgccgccttcgtcgaatttgatttatagtgaggataaaaagatgaattatcagaaaatgcaaaacaactacttaaagaatcaagtgatgagcgcgtcacctaacaaattgattgaaatgcttttgcaggcagcaatcaagaatatcaaattggctcagttagcgattgaaaaacaagaactagcaaaagcccatgaacacttcataaaaacgcaaaatattttgttggagttgcgtacgtcgttagacgaaaaacaaggcggcgaaattgctgaaggtcttgcagcattgtatgaatacatgtatcagcagctgattgaagccaacatcaaaaaagaagtggttcctgcccaagcggttgcagaactgctgagcgagttattagaaagttggcaggccattacccaatcagcttgatcaaatctaccgtttgcttgctgatagacgaaaagcaagtatgtattaagcatatatagagaaaaaaacaacgaagtgctgtttttagccgctcaaagtcgtaaacctcgcgtttgcggcttttttattgcgttgatgcacttcgtaattgtactttgtaaaaagttatagaaggtgtattttttttgaagctgaatttagctttcattaggggacgcttcaataagggggcgcttcattaaatttttacaatgatacccttttcaaaaaggcttattttttaccttatacgacaattctgttattctaaaaaataagaactgttttgcaaggaggtcatttagtgaaaaaagcagttttattcaagccgacagttctgcaattgctcgttattttctgtgtaagcctgctgctattgttgccgcaattgtttggccgtggcttgattttaggttcggatgccgtctttcattttaatcgtttttatgagacgagccagcaaatcaaagaggggaactatcaatactttctttccatttatgggtttcagcaatctggacggatcgtcaatgcattgtatggtccattttttgcgtattttcaagggatattggttttgatcagccgttcctggttccagtaccaacttttatcgaatgggttgctataccttttggcaggaacgtccatgtacacgttgctgcgaaaattaaaagtctcaggctggttgtctgtggggatgggcattctttttatgacgacgtattcgatccaatattgggtcgaacgacaaggcttttcggcttggggggcagcaatattgcctttttgtttcattccattgatcgatatgacgcgctttcaacggattcgtccctttgctgtaggggtatcagtggctgcgctgtttcaaatccatgttttttctagtattttattggttttgatctatattccgttctttttgcgcacttttttgaaaagccaagataaaaagcggctcttgctccatttaactgctgcaattggcatttttcttctgctgactgccaatatttggctggcaatgcttgatctttatcaaagcaatcaattgttaccaccttttgtgaatcaccatatggaacgaaatacgattacgggcaccagcagttattggtggacatccccctaccttttcccattggtctgtgggttgttttttgccggctctttgaagaaatggcaagagatatccaatggcttgaagctgatgactgtcgttgcgggcatttttttcctattatcgtctaactatttgccatggcaatggttatctagtctcgaaaacccattgatagaattgattcaatttccttttcgcttttttgtccctgcgacagtgctgattcttgcgggattgtgtcttttgcggccctatttagcggatagccgcctgaatcggccgatttggctgattttacttttagttgtcagtgtgggtcagatcatgttccaaaccagtaccaagatgagtgagtggcagtccagcgattccgcggtgaaaatcagaaatcactcctatctgtttgtttctgatcagcagacgctgaaagcggcttatttcagtccagacaaggccaaggcactggtgctgttccagcggtcaacccccgattatgttcccatctatcgtgacacaaaggaaaataaatacgatgcctatggggaacaaatcatcaagcaaaacacgacagtgcaaaaagcagtggttaatggacagttgattttgcgctggcaaggggacgattctagctggaaggcattaccggtcatcaattaccagcgaacgaccttacagcttaacggccagccattgacgcgttccgacatcagagtgagtacgataggggcagtgactgttaagcagcaggcaggtctcaatgagctgatcgtggattatgacgcgccttggtattttgactggggactgtgggtgacaatggctgcatgggttttattggctcttggttttctttggaaaaagcggcagctgtttgctgcagttagacgccaaaaataatcaagggaacaaatgccgacggccgctttccgacagcaaagaataatgaattggcttagaggccagagaagcaactgtagtgggcaacactccagcacttctctggcgtctaagtttttttaagaaaaatttttttggaattagttgcgcccgcaaccaattatctttatactgaacctactgtatttaccttacggcatttaaaggagaaaaattatggagtcgatcattcgttcaatcaatcatattgcccgtttagcctcattgtaccgagaaagagagctaaaaaaatatgggttaggtcccatgcatcatacgtacattctaaatgtctgtcgcaaccctgggatcagtcaagaagctttaggtcagttgatttttgtcaataaaagcaacgttgctcgccaattagcagtcttagaagaaaaagggtatgttcgtcggcaaacgagcagtttggatgggcggcgacagcttatttatccaactgaaaaagccttggcgatgcaacctatcctccaacaattgttgaagcagtggaatgagcaagccttagcagggttttctgaaacggaacagcaaaaattgctggcagatctgcaagtagtaaaagaaaactcgcagcgtgctttaaagaaagaagatgaggtccagtgaagctactaaaaaaatacttgcgcccatatattgggcgtatgtctctcggaatcagtatcaagttttttgggtctttgatggatctgctgttgccatggatcctagcctatatcattgatacgatcattcctacaaaaaatgtttccgccatattcttgtggggcggtgtgatgctgctgtgttcggtgattgctgttgtaaccaatattttggccaatcgtatggcttccagtgttgccagagatgctactggcagcatacgtcatgatctttttgccaaagtagcctatttatcgattcctcagatcgaacaagtcggtatcccttcactggtttcacggttgactacggatacttacaatattcatcaaacggtaggcatgatccagcggcttggcattcgagcaccgatcctcttactaggaggcgtattgatcacagctactttagatccagtgctaacagtcgtattagttggagttttgcccttcacattagttgccgctgttatcatttcgaagcgaggaatcccattgtttgcgcaattgcaaaagcgagtagacacactagttcgcaccgtccgggaaaatgtgacaggtgctcgtgtgatcaaagcattgtcgaaagcagaatatgaaaaacaacgatttcagcgagtcaatcagtcagttgttgcggcagaaacaaaggcgaaccgaacgatggctgccacaccacctttaatggattttttcctgaatgcgggtttgacattggtgattttagtgagtgcctatcgagtgaatgcggggctgacacagccaggggtgattattgcttttctcacctactttacgatcattctcaatgcaatgttaagcatcacgcggatttttgtgatcgtttcgaaaggattagcttccgcagaccgtattcaagcggtactgcgactaccagaagacatgaaggtcgttccccttctggcaagagaagatgaggcacacattgtatttgaccacgtttcctttacttatcctgatggtacgaccgtcctgaaggaaatcgatttttctctagacaaaggacagacgttagggatcatcggagctaccggcagtggcaaatcgacgattgtacgtttactgctgcgcttgtacgatccgaccaatggtcagatccgcattaatggccgtgatatccgctcactggatcctgcagagctgcaccaatattttggcattgttttgcaaaaagatgtccttttcgcagatacgatcgaaaaaaatattgattttgggcgccgcttttcaaaagaacaaatcgaagaagctgctgctagagcgcaagcaaaggaatttatccagcagttgccgcaacaattggcctatgaacttcatgcgcgaggaagtaatctaagcggtggtcaaaagcaacgagtcctcctatcccgtgcattagctggtgaaccacaaattttagtcctggatgattcagccagtgcattggattatcagacagacgccaaactacgccaagtacttaaacaacaatttgcggacacaacgacgattttgattgcacaacgaatcggttcgatccagcatgcagataagattcttgtgttggaaaatggccgcatgagtggattcggcgatcatgccacattactggcgacgaataccatctatcaggaaatctatcatggacagacaggaggaagaatcaatgcctagcaagacagtcgccgaaaaaccaaaagagacgaaaaaaactgtgaagcgtctctggcactatttgtatgaagcgaaatggcttcttctattatcagcagttttaatgatggctagcaatctgttttccttagtaggtccactgctttccggttatgccattgatgccatccagccaggtccaggaaaagttgtttttcaccgagtattcttttattgcggatggatgattgctttttatctttgttcagcagtgttaagttatctgatctcattattgatgatccgtctgagtcaacgtgtcgtccagtccatgcgcaaagcgattttcaacaaaatttctgaattgccgatcggctactttgatcgtatccaaacaggcgatatcattagtcgaatcagttatgatgtcgatacgatcaatacatcattagctagtgatgccatccaagtgctgagtagcttagtcaccattattggttcgtttattatgatgttgctgatctctccagtgctcgttttgatttttgtagtgacagtgcctgcctcggttctattgactcgttatttaatgaagaaatttcagccattatttcggcgtcgttcgcgaaagctaggggaattgaacggatttgtagaagaaattctttcgggtcagcaaacgattaagatctataaccaagaagaaccgatcattgaacgatttgatgaaaaaaatcaggccgcagtttcctcttattacaatgcagaatattatggcagcatgacgggaccgtccatcaactttatcaacaatgtttcgttgtcactgatcagtgtctttggcgcactgctatttttattcggtcgtctctctttaggaagcgtctcctccttcgtgttgtactctcgtaaattttctggaccgatcaatgagctggccaatatctttagcgatttgcaatccgcgttggcagcagcagaacggatctttcgcttgttggatgaagaaccggaagtctccgatgttcctgatgcctatgagtttacagaagtaaccgggcgtatccaattggatcatgtctcctttgggtatcaaaaggatcgcatgatcattaaggacctatcgctggacgttgccccaggcagtttagtcgctatcgttggtccaaccggggcaggtaagaccacgatcgtgaatctcttaatgcgtttttatgatccggatcaaggagtgattcgtttagatggacaggacatcaaaaaagcgacgcgcagcagcttgcgcaaaagctatgcgatggtgctgcaggatacttggttatttactggaactgtctttgaaaacctggcttacggtaaagcatccgcgactcttgctgaggtagaggcagcggctaaagcagcccatgtccatgagttcattcaacaattgccaaaagggtatgacacactgatcacagaagatggtggcgggatttcgcaaggacaaaagcagcttttgaccattgctcgtgcgatgcttttggatgcggatctcttgattttagatgaagccacatcaaatgtcgatacccagaccgaggggttgatccaaacggcaatgactgagctgatgaagggcaaaacgtcctttgtgatcgctcatcgtctctccactatccgtcacgcagatgtgattttagtggtccaaaacggtaatatcgtcgaacaagggactcatgatgaattattagctagagcaggtgcgtatgcagccctttaccaagcacagtttgatgaataagcaacgaatagcttgactcagaagaagcagcttagcagttggactaaagacccacgcatagtagcagaattggggcatccaacagatagttgcgtctatgtgcgccgaaaacttgctgaatcgcagaagtacacaatgacacggttcgcagtttgtagcaggccttttgtcgccgcctcttctttttcaatcaagcagtgacaaaattatgcagcgtttccatgacaaaccgcttttttatcggtatacttagaaaggaaacattctgaattattgaaagaaagaagggaacctgtgtgtttcataaacaattaaaagatttccccaaagatttcttatggggctctgcgtctgcagcgtaccaagtcgaaggggcttggcaagaagatgggaaaggcgcctctgtatgggatgattttgtgcgcattcctggaaaaacatttaaaggaaccaacggtgatgtcgcagtcgatcactatcatcgattcaaagaagatgtggcattgatgaaagaacaagggctgaaaacctaccgcttttctgttgcttggacacgaatttttccagaaggccgaggagaagtcaatcaagcgggactagatttctacttggctttgatcgatgaactgcttgctgcagggatcgaaccaatggttacgctctatcattgggacttgcctaaagcgttacaagaagcttacggtggttgggaatctcgccaaatcattgaagattttactaattatgctgcgacacttttcgaagcatttcgcggcaaagtcaaatactgggtcagtctgaatgaacaaaatgtgtttacctcactaggctatttattagctgctcatccgccaggtgtcactgatcctaaacgaatgtatgaagtgaatcatattgccaacttagctaatgcttctgtaatcaatacatttcatgagatggagattccgggtaaaatcggacctagctttgcttacacaccaaactatccgatcaacagtgatcccaaaaatattttggcagcagaaaatgccgaagatttgatggcacattattggatggatgtctacctatggggcgaatatccgatcgcagccatgaatttcttgaaagaacaggggatcgcgccaacgattgagccaggagacatggaactgttgcgttcggcaaaaccggatttcttagggatcaattactatcaaaccgccactaacgcagcaaatccgttagatggtgtaggcgctggtaaaatgaatacaactggagaaaaaggcagttcagaagaaacaggaacacccggtatgttcaaaaaagtcgaaaatccatttgttgatcgcaccaattgggattgggaaattgatcctcaagggttgcgagtggcgttacgccgtatcaccagccgctatcggatcccggtgatgatcactgaaaatggacttggcgaatatgacaagttgacagacaatcatcagattcatgatcaataccgcatcgattatctgtcaagccatgttcacgcaatcaaagaagcaatcagtgatggtgcagaggtgctaggttactgtacttggtcgtttactgatttattaagctggttgaatggctaccaaaaacgttatggtttcgtttatatcgatcaagacgaaaatcaagacggtagtttgacccgttataaaaaagacagcttctattggtatcaagaagtgatcaagaccaatggacaaaatagttaaatcatagcaaaacaaaaagtacgtttctaaaaggaagcgtactttttttgtagaatgaaaatcgttgacaaatgtaaacgatggaggtaaagtagaagagtagagattacagttgtaatcaaaaggtagcctctctcgcttatttggggaacccagtacgatatttcattaaggaggaataaacaatggctgaagggaactatgcaatcgaaggaatgacctgtgcctcttgtgcccagacggtcgagaaggctgtcagcaaagtcacaggtatcgaagaagcctccgtcaatttggcaacggaaaaacttcacgttcgctacgatgaaacgcaggtagatgaacaactcttagcaaaaacagtagccgatgccggctactctcttataggaaatcagctgcaagcaacattccagattgaaggaatgacctgtgcttcttgtgcccagacggttgaaaaagccgtgaacaaacttgcaggcgttcaagcggctactgtcaatttagccacagaaaaattgacagttcattatgacaaggagcaactaaacacggctgccatcgaagcagcggtgacgaaagcaggctatcaagctttcaccgaaaaaactgttgagatgcaatcggcaaagaaagaccccattcaaaagttatggcaacgattttggttgtctgccatttttaccgtgccattattttatttagcaatgggcgaaatgatcggtctgccgctcccttcctttttgaaccctatgacacagcctgtagcatttgttagtacacaattgatccttgtgcttcctgtcatgatctttggccacgctttttttagcaatggcttcaaagcattgttcaaagggcatcctaatatggactctctggttgctttaggcaccagtgcggcttttttatatagtttgtatggaacggtcatggtttatttaggagagacgcatttcgcgatgcatttatactatgagtcggctgcagtgatcctaacattaatcacactagggaaataccttgaatcggtatcaaaaggcaagacctctgaagccatcaagaaattattggatttagcaccaaaaactgctcggatcttaaaaaatgattcagagatcgaagtgccagtcgagcaagtcgtggctggcgatattgtgattgttcgtcccggtgaaaaaattcctgtggacggacaactgatagtaggacattcagcagtggatgagtcaatgatcactggagagagccttccggtggagaaacaacctggtgattcagttgttggagcgagtatcaataaaacgggtacgtttcgctatcaggcgacaaaagttggcaaggataccactttagcacagatcatccagctagtggaagatgcccaaggttcgaaagccccaattgcacgattagctgacaaagtttcgggtgtttttgttccgatcgtgattggcttagcgttactagcaggactggcatggtttttcttcggacaagagtcgtggatctttgcactgacgatcactatttcggtattagtcattgcctgcccctgtgccttaggattagcaacaccaacggcaatcatggtgggaactgggaaaggcgccgagaatggtgtattgatcaaaagcggtgatgcattagaaacgactcgcaacatcacaacgatcgtttttgacaaaaccgggacgatcacagaagggaaaccagttgtgacagatcttttaccttatggcgaacatacgaaagaaacggtcttgcagctagcagcttctgcagaagatggatcggagcatccactgggagaagctatcgtagccgctgccaaacaacagaaattaacattttcttcagttagtcatttccaagccgtccctggtcatggaatcacgggaagattggatggaaaagacgtgctgttaggaaacaaaaagttgatggatcaaaaacaaatagatgtctcatctgtaattgcttctgccgaaggcttagcaaaacaagggaaaacaccaatgtatgttgccatggacggcgcattgattgggttgattgctgtggccgatacggtgaaaacaagcagcgcacaagccattgaacgtctgcatcaaatgggcatcaaagtggcgatgatcacaggagataatgcgcgaacagcacaagccattgctgatcaagtagggatcgatgaagtcattagtgatgtgttgccagaagataaggcggctaaagtggcagaactgcagcaaactggacaaaaagttgccatggtaggtgatggaatcaatgatgcaccagctttagccaaagcagacgtcggtatcgccattggctcaggaacggatgtcgccattgaatctgcagatatcgtgttgatgcgtagtgacttgatggatgtgccgactgcagtggaattgagtcgagcaaccatcaagaatatcaaagaaaatcttttctgggcatttgcttataatgttttggggattcctgttgctatggggttattgcatctttttggcggaccgcttttgaatccgatgattgcaggggcagccatgagttttagttctgtttccgtcttattgaatgcgctacgtttaaaacggttcactccagtcagtaaacgagcagcaagaaactaataataaaatagagaagaaagaaggatcattatgaaaaaaacatatcaagtcgagggcatgaaatgcgaaggctgtgcaaaaacggtacgagaaacacttgctcgagttgccggcgttaccgaagttacagttaatttgaacaagaaaactgcgaccgtcataagcgatgccccagagcaagcattgacagctgcgttaaaagacacttcttatcgtttactttctatctgatgaacgtcgagaagagagatataaaaacaatagaccaataaataaaaacagtcaaagcgagcagtaagcaagactaatacacccaaaaaccgaaaaatctcctttctatcttttggttgttcttttgtctagttttactgcgccgctttggctgtttattaccgttgaacgtctaaataggaatatacccgcgtatcataacggttgcgactgcgggagtattcgatcggtgagccatttttttggtaaacgatttgttgaatttctaatactggatcggttggatcgcaagccagatatttctgatcatataacgagcttttatccgcagaaatcgtccgataagcaccgacaaattgaatgcctagttcttcttttacatactgatagatagaagtttccaagtgagaacgttttagattaggaactaaatggaccggcatgtacgtatgctctagaataaatggtctgccttctaaaattcgcagacggataatcttatagacaggttgttcttctgtcaacatcagtttttcttgaatctctttgtccgggaaagctacttgaaaatcaatgacttcactggtcaattgccgctttgctttgcgcatttcagtggataagccgacatattccgttaatgtagtcgtatctcgatccacaaaaggatgattcaatattttagttccagctcctcgctgagaatagacgagcccttccatagagagaatcccgatcgcctttttgatggtcatacggcttacttgaaactcttcaacgagatctatttggttaggtaataaactatctggaggataggttttattcttgattctggttcttaaaatattggcaatttcttgatattttggcatctcctcacctcgcaaagagtatagctgaaaaaagcgatttcgacaatccgaatcggcagccttttttcaaaataaaagactgacaggttgatgggcctgccagtctttttgtcttaactgattgaagcttcttgttgacgatccagaatacgcaagaatggataccagatcataccgacaagtaccacgtcaatgacttgcagcaagccccctaaccaagaattggttgctaatacaccgctagcaatcactggcacggtccaaggcacagacacaccagttggtgctggaactagcccagcagccatcaccaagtaattgaaggttgttacaactaagggtgcgactacccaaggaatcaaaatcgtcgcattcaacacgatcggcattccaaaaatagcaggttcattgacattgaagataccaggagcaagagccaagcggccaacatcacggtattgctttttcttaaggacaaaagccatcaaaatcacaacagctagtgtcattccagaaccccctaaaccaaccgtgaaagtttccatgaatggtttcgtcacgatatggggtaatgcttcgccattttgataggcttctaaattatccaacatcaatgtgttccagataggatccatgacagagttgacaatgatttgcccatgaagaccaaagaaccataagaactgaaccaagaacagtgccaatagtgtagcaggtaagctgctgccaagacctgttaacggtttttgaatcaattcatagattacatcatgaaggttcgcatggaagacgccggtcatgatcgcattgatcatcaaaaagatggttagcgtaacgatcgctggaatcaaagcagcaaatgacttcgttactgcaggtggcaccccatcaggcattttgatttgccaaccgcgttttgtgacgcgacaataaatctcagcagctaagaaggcagcgatcattccgataaacatccctttggcgcctaatcggtcaagggaaagcacgccagttactgtttcgcctgattctgtagtcatgaaaaatggcgttagaatcaaaaagcttgcaaaagatacagcgccaccaaaaatcccttcaacatcataagacttagacaaataatagccgataccgaaagtaacaaaaactgtcatgatgctcattgttgcattttgtccattaccgaacagggtacttagagtgcctttcgttgcatcattgaaaaaaggcagattgttgataaccactacgattgaaccaaacatcgtaatgggaaaagaaagcatgaacgcatctcgtaatacagtgaggtagcggttttgccctaacgcattggctagcggcaagattttttcagatattttatccataaaaccgttcattaaaaatcactcctaacaactttttgcaatcgattacaattcataatgtatcatgttttattttaaatgtctatacattgtctaataaaaagattgatttttggtagtgcttcctttatgattacggtatcaagcatgaataaggagtgtaaaaaagatgacgtatcaatttccagaaggattctggtggggttctgctgccagcggtcctcagacagaaggaacttttccaggagacaaaaaaggacccagtatttgggattactggtatgagcaagaaccaggaaaattctttgaccgtgtaggccccgaaaaaacatcccaagtctataagcggtataaagaagatattcaactgatgaaagaaacaggacacaatacatttcggacatcgatccagtggagtcgcttgattccagcaggaactggcgaagttaatcaagaagctgtggctttttatcatgattatttcgatgaattgattgcaaatgggattgaacctttcgtcaacttgtatcattttgatatgccgatggccttgcaggaaaaaggcggttggttaagtcgtgagacagttgaggcttacgtcgtttttgccaaaacttgttttgaattgtttggtacaaaagtcaaaaagtggttcacgcataatgaaccaatcgttccgatagaaggtggctatctctatcagttccactatccaaacgaaatcaacatgaagcatgctgttcaagccggcttccatgaaaccttagcgagcgcgaaagcaatcaaggaatatcatgcgctagaattgggtggagagatagggattatcttgaatctgacacctagctatccgagagatgaagcaaacccggaggatgttaaagcagcccaaatcgccgatgccttcttcaaccgttcttttctggatccagcagttaaagggacatttcctgaagaattagtcacgatcatcaaagaattagacatgataccggaacatgaagcagaagatttagtgatcatccaagaaaatacgattgacttattaggcatcaattactatcagccacgtcgtattatggcaaaagaaacaccgatcgaccacacgaatggcccattaccagatgattattttgacaattatgataaacctgacaaaaaaatgaacccttatcgtggatgggaaatctatgaaaaagggatttatgatattttgaccaatacccgcgagaattatggcaatatcaaatgctatatttctgaaaatggtatgggcgtagaaggagaagaacgttttgtcaatgatgaaggaatcattgaggacgattatcgcatcgaattcgtcaaggaacatttgaaatatgtccaccaagcaatccaagaggggaccaattgtgttggctaccatatgtggacatgtatggataactggtcctggacgaatgcctacaagaatcgttatggcttcatttctgttgacttgaataatgatgccaagcgcactattaaaaaatctggccgttggtacaaagaagtttctgacaataacggcttttgattcaaaacacagtgaagattgcttcactgtgttttttttattgtcaaaaaatggtgctgtctatagcaaaagaataggactgtataatccatgctcagttttataaataaaaagactagacttataaatgtaagcgtggtttcctatagaggaaatcggtttcactaaattataggatggtttttgaaaggagaaaaaaatgaataagtttatcgcgtttatggagaagcattttattcctattgcttccaaaatcggttcacaacgtcatctagttgcgattcgtgacggttttatcgtaacgatgccattgatgatcttgggatcttttggggtattgatcaataatttgcctattccagcttatattgattttatgaacggtatttttggtgaaggcacctggcaagcatttggcaataatttatctgcaggtacattttctattttagctttattgattgcattcacagtttcttataacttggccaagagctatgaccaagatgcattaggagcaggagcaatttcagttgccagcttttttgcattaggtgcaatggccacagatgctgatggtttgctgacagctgcgggtcttggttcacaaggattatttttggcattgatcgttgctattatttctactgagatcttccgtcgtttggcaggcaatcctcgtctagtgatcaacatgcctgatggtgtaccacctgcagtttctcgttcttttgcagcgttgttcccagcaatgatcactgtttcgatctttgcattgttcacagcaatcttccaagcattcggcgtatcaagtttggttctatctttctatgagcttgtgcaacaaccattcatgggattggcaaactcttatccagctgcattgctactagggttcatttctgctttcctttggttctttggtttgcatggtgcaaatatcatcgatccatttatgcaaacgattaacattccagctatcgaagcgaatacgaaagcgcttgaagcaggagacaaattgccgtatattgtaaataagccgttttttgattcatttgttaatataggtggtaccggtgcaacattaggcttattgatcgcaattttcttggttgctcgtcatcataaagcctatatgactgtagcgaaattatcattggctccaggggtatttatgatcaatgaaccagtgatgtttggattgccagtcgtgttgaatccaattttgttcatcccttatgttttgacaccacttgtattagtttcaactgcatattttgccacagcaacaggactggtaccagcatgtaccgttattgcgccttggacaacaccaccgatcattggtgggatcttgtcaacacaaagcattgctggcggaatcttagctgcagttaatttgattatctcgatcgtgatctatcttccattcgtgaagatggcacagatccaagaaaatcgtcgtctgaaagaaatctaaccgatcaaaattaggctgggacataagtcagaacaagacgaaactacccgaacgaatgaaaatgacaatcctgttgctttagttgctagttggtggctaaagcaacaggatgggtagtcgtctttgttgcttatgccgcagtcttttttaattaataggatgtgaggtgaatgttgtgccaaagtatgttgagatagcagatgtccttcgaaaaagaatcaaagatggaacttatcccaaagagagctttctgccgcatcaaacggagttagtaaaagaatttggtgtcagtcggatgaccattaagaatgccatcaatattttgatcatggagggactgttgctttcgaaacgaggatctgggacgaaagtgttgaaccattctttttgggatcgtgacacgtcttctgtaaacgaatacaaaggacttagttaccagatgaaaatgcaaaaaagagatttacaaagtcaggtaattaccttcgaagtctgtttcccagatagcagagtacaagagatgttgaaagtcgctgcggaagagccggtgtatcatgtgattcgtttgcgaatattagatgggcaaccttatattttggaacattcgtttatgccagtagatttagtgacgggattaacgaaagaaatcttgcatcgatcggtatatgattatttgttagaagagttgaattataagtttgccggtgcttatcgaacatttcaagcagcgaaaagtgatgagtatgatcgtcaatatttgaagtgtcaatcggatgatccagttttggaattagagcagattatttatttagaatcgggaagaccgatcgattattcaagaagccgaaatcggtatgatgttcgcgggtattccatgttagacatgaaaccagatcttttaaatcatcgaaaaccataacgaccaaagtgctcgctgctttggtttttttgtttttgatggccgaatggtttgttttcgtatagattctgagaatcaggtatactaatagtacgaagatagatacaagcagttttcaatgattgcttaaggagtgaagaaaagtatgaacctgctgtttgcgattgacgatacgtttgtagaacaattaaaaacaaccctctattcaatttggttgcacacatcggcaagccgattggatgcatttgttttacaagagaaggaacttgctcagacagagaaattgaatcaattttgtcatggactgggaattgtctaccatccagtcattatcggtacaggatctatttttaaacaagcccctgtcagtgatcgttatccagagtcgatctattaccggttattggcccaaaattatttgccgaaagatctagataaggtcttatatttagacgcagacatattgtgtatcaacgatttgcagccgctatatgaattaccgcttgaagatcatctttatgcggcagcaaaccattcaaaattaacagaggttacgacagtcatcaataaagtgcgtctcaaaaattatgagtctgaaggatatttcaattcgggcgttttgctgatgaatctgactcagttacgtcaagaagtaaaagaaaaagagattgcggcatttattcagaagaatcaattgaatttatttttaccggatcaagatattctaaatgggctgtatggggatcggatcttgggaattccagaccaactatataattatgatgtaagaaaaaaccgtacatatgaaacgatcagcctaggacactgggacttagactgggtcatcgatcatactgtattgctgcatttttgtggtaaagacaagccttggaagaaagggtacaagagccgttatggttcgctttataaatatgttgcccaacaacaaagcaagtatagcaggtcgttatcagacaactagagctgaaatcgaccaacgatctctttgagacgagcattacttttttgaaatgaaggtaggaatgataccataatattagaaactaaggcaaaagcagcaaaccgttgctagattcatttaaccgagtagcggaagaaaagtggagaacgaaagggagcgatagaaatgaaatttttgctttggcttgtttgtgtggtaggaatcgagattactgggattatttccagcttgttcgcgggtgatattgctgcgacgtatgcccaaatggacaaaccgtttttggcacctccaggagggattattggtatcgtttggacgattttatatgcctttatggggacagctttgtttttactcatcattgcgaaagtaaatccagcatttaagaaacaagcctatatcttctttggtatccagcaagtgttgaactttttgtggagtattgtcttttttggctggaatctttattgggtaggaacagtggttatcgtcttattggttttgacagtcatcgtctgtatgtttttatttgcccgaatcgataaaagatccacctatctttttgtaccttatctgatttggtgtctctatgcggggtatttaactatcggattaacactattaaatagttgatagtaacaaaaaacaagcgcagatttctgcgcttgttttttgttataaatattcttctgtcaactccatgaaggtatcgatatcttgtaagacccgatcgattccggcttgccagaaatcaggttttgtcagatcaacgcctaaatgtttttgggccaattcttccgtcggcatagaagctgtgtcttgtaacaaagcaatatattcttcttcaaaactcgtccctttttggttggcataagcatagattcccatgctgaaaagatagccaaatgtgtaaggaaagttatagaaaggaacatcatcaataaagaaatgtagttttgccgcccagaaatgtgggtgatagctagctaatccatcggcgtaactttctttttgtgcagccaccatcatttctgtgatttgttcagcagaaaccagccctttttgccgtgcttggtaaaaactgttttcaaaaataaagcgggcatggatattcatgaacatggcaatggcattttgcattttggcatctaacaaattgattttttcttcttttgtttttgcttctttcaatgttgcatcagcaacgattagttcggcaaaggtacttgcagtttcagccacattcatcgcataatcctgattaagctgcggcaagtcccaaagaacactactatggaaagcatgacctaactcatgcgccaaagtggctacctcattgacggaattactataagtcatgaaaatacgtgattctcttgtttcaggcagacttgtacaataaccgccaggacgtttgccaggacgatcttctgcttcgatccaacttttttcaaaggcttcttgcgcaaaatcagccattttgggactgaattttttaaagttttctaaaatgaaagcagctgcttcatcgaatgtataggtacgttccttcatttcacctaaaatgatcggagcatcttgatcctgccactccattttttcttttccgaataattgggcttttcgtgtcaaaaagtccacgatcggttgtttgttcttctggatcgttccccacattgcgtctaatgtcgctttttgcaggcgattatactcgagaggctccttcagatagtcatctacaccgtgcagtttgtaattggagagacggaatccatccagatgattcaatgtatcggcaaataaatcttctttttctccccaagctttttcccactccgcaaatagttgagcacgaacttcaggatctgggtcacccatcattttgttgaaagcttgaccagctgaaagagtaatcgttgttccatccgaccgggtaaatggaatcgcaatcgaagcaacaatcgtatcataatgctgactccaagcatttagtccgtctaaagaaagtgtgttaataatcgtttcttctgcttccgacaaaagctccttgccgtcgcgacgaatttcgctcaaacgaaaggcgatagtcgcaaagggttcttctttcaatagtgtctcccagtcttcatcagaaatttctgtcaattttttcgaaaaaactgtttcggctgcttgtagcattggtaatttggcatagagatcgcccgaaagtaattttgcctgattgtcattaacgttggcagatagcaatgcattgataaagctgctgcactgagaaaatcctttactgattgtttcggacaatgataataattcagctaattcctctggttgagaggcattgtcgggttgccacgcatctacttttgtgcgataagttttgatttgtgcatctagttgggacattcgttcttgcagttgggtagacgtgctgccgcctgaaaaaatcgaatcaaggtcccagttgagagaataagtcatcttgggtgttgctcctttcgtttatcagatggtaataagtatagcacacccttcgaaaagtagttgcagagaatactgaaaatggtaagattagaaaatgaggggctgagatgatgaaaaaaatgtggaaagaaccaaatttttatttcacgattgcggtagctgtgatggtgattttatttattagttcgtcacaaacttatgaacaacaatcacaagtcggtttgctttctcgcctgttaaaagaagagccattgaaagaatggttgagcaaattcgctttctcttatgcaggatctgaaatcagtattgccgaaaaaggttatttttcttttgtggaattttttattcgtaaaggggctcatttctttacttactttgtattaggaggtagcttatttctatcattgagctatcgaaaaattccctattggctgtcagctttctttggctggttggcagcaacagggtatgcagggatggatgagtaccatcaaatgttgaccggtggccgtacacctttgttccaagatgtcatgctcgattcagctggagcactgacagctgtcttacttagttgggggattcttagttggcaaaagcgaggcaagaaaagaaaataagattattttttaacagcaaccataactaaaatgcaatcaatcagctagaaatagtaaagtaaagatagaggcggaaaagatgcaagcagatcacagcagtaaaataaatgatccgaatagacgacaaccggatatcgtggtgcatgaaagtctaccagtaggagttgccttagcaatggcagggggattcttagacgcatatacttatctctttcatggagaagtgtttgccagtatgcaatcaggaaatgtcattttgttaggaatcaatttggcatctggagagtttggacaggctgccagatatttaccgccaattttgctgtttttgatagggatcatagtgactaatggcttgcagcatcgtttcccaacaggtggtagaattgtttggcaaaatgtagccctcttctttgaagcacttggtatttttcttttaggattttttgctcagacattgccaaatgtctttgtggattctggactttctttttttgcagccatccaatatgcttcttatcgcagattagctggaatgccctatgcaacgacgatgacgaccggaaatttgcgttcaatggcggattatctttatcagcgtttcttcaaaaaagatgctactgtagattataagatcaagtatatcgcgatgatcatcggaggatttttcttcggggcagtcagcagcagtttattaggtatgtttctttttcaccgaacgatttgggtcgtatcgggcatattactttttgtactgacgattacgatcagaaaccagaatcgggtataaaaaaggacggagaaataattctccgtcctttttggattatatagattaaataacgataacaggcgttcctacttctaccataccaaataattctttcatcacacctggcggagtattgacacatccgtgagacccgcgggtcttccataaatcaccaccatattctggttgccaatctgaatcatgaatcccaacgccagtccaatcaataggcatccagtagtcaacaggagaagaataatcttcgccggtcaatgtagcattccgctctttgttccaaacgtaaaatacacctgtaggagtgggtgatttaggttttccagaaatgatgtctgtttcaagagcgactgcaccgtctttgtaataccacatatgttgattttttaaatcaacttcgatataagtgtttccaaacagtggaccacttggatctgcactacccaagaccactggagaacgagtaaagtcttctccagtctttaaggcttcgatcaatgcacttgtttcagaatcagtttggatcgtccaacttagtgtcccagctggtacggatacctcgccttgtttcgtgcttttgaacgtagaagcattggtgcttgtgttgtattggttccctaaatctgctacataattccgtactttttcttcatcaatcgtggtttttccatctttataagagagccaatccatgattgttgcggtcggaatctggaaagttgagccattgatggaataattagcatttacttgagcaattttattcaatgattccatttcttttgctagttctttgtcatcagaagtaacgctaggtttcttttgatacgcagtcaaatccaattcactttcgccgctagtaattgctttttgtaattccgtgacagtttgttcgacgtcaatggcatcaccaacaacttctggctcaatcgagaatccatcatctccttttttcaatgtggcatctttagaagcggtccgaccttcatttaaggtttctaaagcctctttgattgtggctgtttcacttgtcaacttttgttgatcaacagaaacggtacctagttttttatcttctgcagcagatacataggccattccccatgtccactggttttgttcatctttcaaatcttccaattcttttgtaaaatccgtttgcaaaccaaattgagccaaattgatggttttccaatccgtattgccttctttgattgtaaaagactgtttgctgtaacggtcatgcaacaaatcattggcttcagcgaccgttttattgctgatgtcaatatcatcgatcgaggtatttggcaagaaacggtcttgataatatgtacttcgataagcgtatccgcccgcaatcacgactagaacggcagcgatagcgatcagaacgatctttttcgtcttactctgagtatgtgtgtgtttgttggatcgtgtcatttaaaggctccttttatgatgatttaaaaatgatagatcggctaaatcataccatattctacaagaaaagcgaattgattaagtgaaagttccatgaaaaaatagagaattcttaaattataaaaagagtctgctcataggacagcaaccaagaagtgattcaacgaaagctgctgtgtgataaaagcacagcagctttacgcaatattctttggatcaaagtacacgaagcatcttgattcaaaggatctctttcttgttcggtcttatgttacagactcttgtaagtggcttatagcaatcgttttattgattgtcttccgcatctagtttcgcaaaagcttcatctagaatgtctttcaattgttttgcagaagcagtcattcgatcttgttctccatccgtcaatggaatttcgattactttttggattccttgggcattaatgatagcaggggcaccgatataaatatcttttaagccgtattcgccattcataaagacagaaagcggcagtactgcattttcatcatccaaaatggcacgagtaatacgagccaaggcaacagcgataccatagaaagtagcaccttttttctcaatgattgtgtaagctgcatcacgaacactgaagaacaagttaaccattgcttcttcatcaatatcggggttgtttttgacccattcataaatttgcaatccggcaacatttgcatgagaccaaactgggaattctgaatcgccatgttcccctaaaatataagcatggacattacgtgcatcaacatcgatcaactcagctaatgcttgacggaaacgagcagaatctagtgaagttcctgaaccgattacgcgctcttttggaaaacctgagaatttccatgttgagtaggtaagaatatctactggatttgcagcgacaaggaagataccgttaaatcctgaatcaacgatttgtgtaactacttcacgattgatttttaagtttttgtggactagatccaagcgagtttcgccaggtttttgtggcgcaccagctgtgatcaccacgacatcggcgtcatgtgcatctgcataagtggcagcatagatttttttgggtgaggtaaatgctaacgcatgagataagtcgatagcatctccttctgtttttgctgtatttatatcaatgatccctacttcttgagcaatattttgagtgactaacgcaaatgcataactggaaccaaccgcaccgtctccaacaaggattatcttttggtgatcttttttatttgtcttagcagtcatttgtgtatcattccttccgcatatttgttttactaggtaacatcctaacactttcaagcgattttgtcatgtgatttgctcaacaatgttacagataattttgctgtttcatttgtaaatgctttctttgttatcctgtaggaattaggataaatcagggtttctaatgatttttttaagaaagagaaattctgagcaaaggaaagacacggtaacagtccgttatgtgttataatcgtagtgaacgtttttactgggcagaattgtcgtgcccagtattttgtggtggtaatttttttgaaaaaatggagcggatcaaaaaatgaaaatgattataggtctgggaaatccaggcaaaaaatacgaaaaaacaaaacacaatgttgggtttatggtagtcgatgcgttagcggagaaataccaagctacttttaaatcatcagcttttgaagcagaaattgctgaattttttatgaacggtgaaaaaatcatgttggtcaaacctcagactttcatgaatgaatcgggccgggcagtagggcctttaatgacttattatggagtttatcctgaagagatcgtggttatctatgatgatcttgatttagcgttaggcaaaattcgtttgcggcaaaaaggcagtgcgggggggcataacgggatgaaaagcttgatttcccatcttggtacatctgtatttgatcgcatcaaagtagggatcgatcgaccacagccaggccggacagtggtcgatcacgttctaagtccttttgctaaagaagaccagccgatgattctgcaaagcttggataaagcagcagcagcaagtatcgattacttgaccaccggtgattttcttgccacaatgaatcgatttaattaaggaggacctgtatggatctgattgaactaataaataaggtgccgcaagtcgctgcctggcaccaacaattaacggatcacgcatctcgacagctattgactggcttagcaggttccgcaaaaacattagcttttgccggagcttatcagaaatttgatcggcaagtcattgttgttacaccaaatctttattataccaatcaagttgccgaagatttgcggaatattattgacgacgtgtatgtctttccggtggatgaagtgttgtcggccgaaatggcgtttgcttcaccagaagctcgagcggagcgagtgacagcattgaatgctgtcgctaccgggaaaaaaggaatttacgtcatgccgatcgctgcattgcggaaatatctgcctgctaaagatacttggctgaactaccaattttcttggcatgtgggggatgagatcaatttagatcagttgccgcagcaattggtattgatggggtatgagcggcaatcaatgattggcaaacctggtgaatttagtattcgtggaagcattttggatatttatcctttgaaagctgaatatccggtgcggatcgagcttttcgatgtggagatcgactcgatgcgctcttttgacgtggaaacacagcgttcagtagaaacgttgtcagaagtaacgattgttcccacaacagaattagtgttttcgccagctgatttagctcatggacaaaaagttctgcaagagttgctgaagaaacggctcgctgtagtgaaagagaccacagataaaaactttttagaagattattttggtcaattagcatcggcttggcaaagtggcatacctgacgagaatgctcgttattatgcggatcttttgtatcagcaaccgacgagcattttggattatttttcaaaagatgcactgctgatgatcgatgattatgctcgtattatggagacaaaccgcgagattgaacgagaagaagctgagtggcatacacaaaaaattgcagaacttcgcgttttttctgagcaatctttcgggcaagatgtccagcagctgattcaaaaagaacaattttctacaagtttcttctcgctttttcaaaaggggatgggaaatcttcgttttcaagcgatccacaattttcaatatcgaccaatgcaacaatttttcagccaaatgggtttgctgaaagttgaagtagatcgctgggagaaacaacaacaaacggttgtctttttagtaagtgattcagaacgagcaaaaaaattggaacaagattttcgtgatcactccatttacgcagtacaaaccacagcagatcgactttttacaggtcgaacgcaaatcgttgtagaaacactgcaaagcgggtttgaaatgccccaagataagttggtcattgtcacagaaaaggaaatcttccaaaaaatcaacaagaaacgtacgcggcgtcaaaatgtgaccaatgcggagcgattgaagagttacaatgaattaaaagccggcgactatgtcgtccatgcgaatcacgggattggtaaatacattggtatggaaacgctggaagtagatggtgtacaccaagactatatgaccatcctctaccaaaatgatgataagctgtttattccagttacccagttgaatctgattcaaaaatatgttgcctctgaatctaaaacgccaaagatcaataaattaggcggcagtgagtgggcgaaaacgaaacgaaaagtttcagcaaaaatcgaggacattgcagatgatctcattcttttatacgcaaaacgcgaatcggagaaaggttacgcgtttcagcctgatgatggctatcaaaaagaatttgaagatgcctttccttactctgagacagatgatcaattacgcagcactgcggagatcaaacgtgatatggaaaaagaaaaaccaatggatcgcttattagtcggagacgttggctttgggaagacagaagtggcattgcgggcggctttcaaggccatcaaagagagtaagcaagtagcctttctggtgccgacaacgattttagcacaacagcattatgaaacaatgctggatcgctttgaagggtttccagtcaatgtcggtttgttaagccgttttcgaacgaagaaacagcaaacggaaacgatcgagcaagtgaaaaagggccaaattgatattttagttggcacgcatcgcctgctgtctaaagatgtagagtttgcagatctgggattattggtgatcgatgaggaacagcgttttggcgtcaaacacaaagagcgcttgaaacaattacgctcgcaagtcgatgttcttacattgacggctaccccgattccccggacactgcatatgtccatgttgggggtgcgggatctttctgtgattgaaacgccaccggaaaatcgctatcctattcaaacttatgtgatggaaatgaatccaggtgcagttcgagaagctattttgcgggagatggcacggggaggacaagttttttatctctataatcgagtagatacgattgaacgtaaagtcgaagagctccaagcgttagttccagatgcgcgtattgggtatgcccatgggcagatgacagaaatccagctagaaaacacattgtttgattttatcgaaggacaatacgatgtgttggtgacaaccacgatcatcgaaactggggtcgacattccgaacgccaatacattatttgtagaaaatgcggattacatgggcttgtctactctttatcaattgcgaggtcgtgtcggtcgaagcaatcgtgttgcgtatgcttattttatgtacgaacagcaaaaaattttgaacgaagtcagtgaaaagcggctccaggcaatcaaagactttacggaattaggttccggatttaaaatcgcgatgcgtgatctttcgattcgaggtgcaggaaatctcttgggggcgcaacagcacggatttattgatgctgttgggtttgatatgtactctcaaatgctgtcagaatccgtagcgcgtaaacaagggaaaaatacacaagcggagaaaacaacggttgagatcgatcttggcatcgatgcgtatctgccaacttcttatatagaagatgaacggcaaaaaattgaaatttataaacgcatccgtgaattggattctcaagaagcggtggatgagctgcaggatgatctgcttgatcgctttggagaatatccggtcgaagtggctcacctattaactgtcggagaaatcaaaatgaatggggatcgggcattgttagatacgatccgtaaacagcagcaaacagtgatcctaacgttaagtaaagttggcaccaaaaactattctgtcgaacagctgtttgaagcgttgaaagcgaccaagcttaaagcgacgatgggtgtcgatcacgagcagatgacgatcaaacttcagattcctgctgtgatgaaagaaagcacttggctgttagagattcaagattttgtcaaagcgctacgggaacaaaaatacgtgttacaagaaaattagttataaaggggcggagaagatgccaaagtcacaattaaaacggacgatggaaggagcatttattttaacgattgcttctttcattgccaaagtgttaagtgcggtttgccgcgtccctttccaaaacttagttggtgacgaagggttttacgtctatcagcaagtctatccaatctatggattagctatgacattggctttatctgggttgccgcaatttatttcgcgcgtgatcgccgaacaacctgatcctcagaagcagcgtgcccagatccaagtcatctatccgtatgttttttggacagcgattggactatgggcaacgacgtttttctttgccgatgttatcgctcgggtcatgggagacgcaggactggcatctttgatccgcgtggtatcctttacattcctctttgtaccacccctgactttttatcgtgggagtttccaaggaaatttacagatggtaccgacggcagtttcccaagtagtagaacagctccttcgagtcggagtgattttagtagcggccagtttttttcatctcttctcatgggatgtttatcagactgggactttggcaatgtccggcgcattgattggcggacttgcggcgtgggggattttaagctattatagtcggaaaatcaccggtcggtcgttagcgatccccacaaaaactatgcctaccgcacatgctccttccttgcgtcgccgttttttgattgaagggggactgttgaccatttacagcggttttttgattttgtttcagttggcagattcctttttgatgacgaactcacttgaagccagcggtttgacggaacaaagtgcccgcattgcaaaagggatctatgaccgaggacagccattggttcagttaggtctcgtggtagcgatggctctaagttcgactttcttgccaacattgacgaaatatctgacagtcaaaaatcagcacttgtttgaaaaatcagctaagatgtacttgcggttgactttagggattgccagtgcttctgcagttggcttggctatcctgcttccttatatcaacttcgctctttttaaagatggtgccggcaacagtgcgttggtcttatttgtttttgcggtcgctttgatggctgcaatccaagcgtatcaaagcatccaacaaagccggaaccaattccgtgtagggatttatgcagcaggatgcggccttttgcttaaaggtttgctgacgtggcccttgacctatcttttaggaacaactggtgcgagtttgagtacccttttaggtttgatcggtactttaatctattttgtgttttctgagaaaaaagcattgaacagcttttggatagagcaagggtatggcaaaaaactcctgctttgtttagggatcatggcttgcgcactgtttttatattatggtgtgatcactctgttgagtggaggtccagtgacgaaaagactgcaagcgctgattttttgccttggaggggtcttttttggcgggacagttttcattataatggctctcaaagttaaattattaacgattcgagaatggctgctcgttccgtttggaaaaaaattgttgaaattaagaggtggaaaaaatgagattagataaatttttaaaaatatcccggattatcaaacgtagatctgttgcaaaagaagtagcagataaagggcgtatccaaatcaatggaaaattggcaaaatccagcagtgatatcaaagtcggcgatacggtgcgtattcagtttggaaataaagtattagaaataaaagtacaagaattacacgaatcaactaaaaaagaagatgcagctaaaatgtacgagatcctcaaagaagaacgtatctcagaaaatgcttgatttttgtcccattttcagttagacaacttttgtggatgttggtataatggaaaaaacaatcacagtgacaggagcgaggtcagcatggataaagagccaaacaaacaaatagaactattgcagaccgagtatgccaaagagcaatttgccaagttcgaaaaagaacgacgacaagtggtctttcgtcgacgtcgacttgtagctgtttttgttgcagcgctagtgatttttgcaatcgtaggtattcaaatgttcaatgatcaaatgcgtctgcaaaaattacaagagtataaagcagaaacagtagcaaaacaagaagcagcggacaaaaaagtgacacaacttaagcgagatgtagcactgttgcaagatgacgaatacgttgcaaaattagctcgcagtagattcttttattcaaagaaaaatgaaaagatctaccctgtcttgccggatgcttctgattcaaaaacagaaacaagcggtgatgaggcaaatgctagtgatacaaagacaagtgattcggaataaacaaggtcatacctactcatcgcagtagttgaaatgattaaatgggtaaaaattaggaggaacattttttatatgtcaatcgaagttggagcgaaactaaagggcaaagtgtctggtattacaaattttggtgcgttcattgatcttggtgaggggaaaactggtttggtacatatcagtgaagtatcaaatgggtttgtgaaagacattcatgacgtgttgtctattggcgatgaagtaaccgttgttgtgacggcaatcggcaatgatggaaaaatcgggctatcgatccgtaaagcagaagcaaagccggaagaaaaacgtgattttcctaaaaaagaattcaatcggtcaagtccgaagaaatctttttcacgcaatcaaccgacgaacgtaaataaacaagacttcgattcattgatgagttcttttctaaaagatagtgatgatcgtttatcttcattacgacgtaatacggaaggtaaacgcggcggccgtggcggtcgacgtaactaaacaggatgagcaagttgtcaaaagaatttgtgacgtaacgataagtatttcaaaaaatatccgaactatatccgattactcctaccatgtagtaggctttcgccgtggagcacggcgttttggaatcggcatagttcggatatttctctttcttagcaatagacagtcatttttagtttgaagttaagtatagaagcaagagacacggagggatagaatgcttaagcaaaaagtctatcatgcaatcaaagccgatggatgggtagaggatgctacttgtttgcttgctgtttcgacaggcgtggattcaatggttttactccatgtgatcgaagagttgtttcagcaaggaacatttggcgtggctcatgtcaatcataatctgcgggaagcttcagacgacgaagcagcgttcctgaaggactattgtcaaacgcgcgggattccatattatgaacgagtttggcaagatccgccccaaaatggcatcgaagcggccgctagagagttccgctatcatttttttgcagaaacgatgactcttcagagttatgattggttattaaccgctcatcatgcagatgaccagatggaaacgatgctgatgaagatggtgcgagagggacgcttgcaaaacgcttcgggaatcaagcgcaagcaaccttttggtaacggttatttgatccgtcccttcctaacgatcgccaaagaggagattagagactatgcaagaaggagagggatcgcttatttcgaagatgaaacgaatcagcaaacgctgtttcaaagaaatcgcctgcgtcatcaagcggtccctctgctgaaagcagagaacccgagagctcttgatcattttcagcagctttctcaagagatgatctatgctgaccaattgatcaaaaagcagcaagcagattggctcgccacgatacttcatgaggaagctgaaggctattttttaaacttggatgaattggctgcgtttaccgcagcagaacgctattacttttttgaaggtttgctacagaaagtttcccatgataaaggaatctcgtacaatactaaacaacgagagcagttgctgtatctactagaacataatcccagtcagtggataatcgatttaaatcaagattggcagattgttcgagtttatgatcagttgaaagtcactgctgttaaaaaaggctctcacctccaaacgcaggtagatgagacgcattttgttctaaaaaaaggtgaaagtttctttttgtcggaccatgaatggatcggctacattccaagtgacgcccaagttccagaaaaagtcatggattggtcagagatttcacaaattttaccgatacaatatcctgcgacagtttttttgcggaagcgaaaaccaggggatcggttacagctgaaaccaggtcttacgaaaaaaatcaggcgtttctttatcgatgagaagatttcgaatgaaaagcgtgctgctagttgggtcctgacagacgctcaagagaatgtattggcacttttgccttatctattttcctatttgagtattgagcaagaaactgataaaatacactacatacttctttataaatatcggaagtaagagttggaaggagaactttatgttagacaaagatattgaaaaaattttgattactcgagaagagatccaaaatcgttgttctgaactaggtaaagaactgacggaaatctacaaagataaaaatccattggtcgttggcgtattaaaaggagctgttccttttatggcagacatcgtccgagaaatggactgtcatttggaattggactttatggatgtttctagttatggaaacgcgacaatttcttctggcgaagtgaagattttgaaagatttggatacaaatgtcgaaggccgagatatgctgatcgtagaagatattattgatagcggtcgcacattagcctatctagtagacctatttaaatatcgcaaagcaaagtcggttaaaatcgtgacattgctagacaaaccagaaggacgtgtggtgaaaatcgatgccgactatattggctttgatgtaccgaacgaatttgtggtcggctatggattggattacgcggaacaataccgtaacctcccttatgtgggtgtcttaaaaccaagcgtttatcaatcaaattagtgactgatctaaatcagttgtgatacaattaaatggtcaggattgataaaacaaaatagccaaggaggtacgcatgaataagaaaaataacggtatgatcaaaaataccttatattatgtacttgtcttgttagcaatggtcatggtcgtctatttcatttttggaaatggcaatcagcaaacgccaacaatcgagtactcaacatttacggagcagctgaaagacggaaaggtcaaacagtttaccgttcagcctgctaacggtgtttaccggatcgtcggtgaatacaatgccgaacaaaccgtcagcaatgacaatgggctttccgtactaggaagcacgcaagcaagtacgacacgttttacaacgatcattttgccgaatgactcgacattgagcgaggttacgacattagcaaaggatcaaggggttaaaacaacgatcgaagaagaatcgaacagtggtgtttggttatcgttgctgattagtttcttgccaatcgtaatcatcattttcttcttctatatgatgatgagccagcaaggcggcggtggcggcggtggcggccgtgtcatgaactttggaaaatccaaagcgaaagaggccgacaaaaaagccaatcgcgttcgtttctctgatgtagcgggtgctgaagaagagaaacaagaattagtcgaagtggtcgaatttttgaaagatccacgacgctttgtcgaattaggtgcgagaatcccagctggtgtgctgctagaaggacctccagggacagggaaaacattgctagcaaaagcggttgccggagaagctggcgttccgttttactctatctcaggctcagactttgtggaaatgtttgtcggagtcggagcgagccgtgtccgggatctatttgaaacagccaagaaaaacgcaccggccatcatctttatcgatgaaatcgatgcggttgggcgccaacgtggtgccggcatgggtggtggacatgatgaacgtgagcaaacgttgaatcagttattagttgaaatggatggatttgatggcaatgaaggagttattgttattgcagcaaccaaccgttccgacgtgttagacccagccttgttacgtccaggtcgttttgaccgacaaattcttgttggccgtccggatgttaaaggccgtgaagctattttacgagttcacgcacggaacaaaccgttgtcggatgatgtggatttgaaagtcgtagcacaacaaacacctggttttgccggtgctgatttagagaatgtcttaaatgaagctgcgctagtcgctgctcgtcgcaataaaaagaaaatcgatgcctctgatattgatgaagcagaagatcgggtaatcgcaggacctgcgaagaaagatcgtgtcatcaataaaaaagaacgcgaaatggttgcttaccatgaagcgggtcatacgatcgtcggtttagtcttaagccgtgcgcgggtcgttcacaaagtaacgatcatccctcggggccgtgctggcggttacatgatcgcattacctaaagaagatcaattcttaatgacgaaagaagatatgtttgaacaaatcgtcggattgcttggtggacggacagcagaagaaatcattttcggcgttcaatcaaccggagcatccaatgactttgaacaagcaacagctttagctagaagtatggtcacagaatatggtatgagcgacaaactaggtccagttcagtatgaaggcaatcatcaggtcttcgtcggtcgtgattatggtcaaaccaaagcttactcagaacaagttgctttcgagatcgatcaggaagtacgccgtatcttgatggaggcacatcaaaaagcacatgagatcatcgaagaacatcgtgcgcaacataaattgattgccgaaaaactgcttgaatatgaaacattggatgcaaaagcaatcaagtcattgtttgaagaaggcaaaatgcctgctggaactgagaattcagaatatccaagcgaaaaagctcaaacttttgaagaagcaaaacgcgctttagaagagaaagatgctgaaaagcaagctgctgagaaaaaagattttgatcagcaagtagacgaacttcgtcacaataatgaaaaccacgaagcttcatctcaagataaaacagaggacggtcaagagtagtcgttcaattatcaataggtgattagctatcgtaaagtctagggactgtgtcataagtcaaaacaagagaacagattcgaatgaggttcggaccagttgcttgttttacggcttgtgccgcagtcctttcttgttaacaaatcgagaaataaaccgacagaaaacattggcttttctctaaaatggtggcattcagttgaaaaaaaaacaagttcctagtatgattcactaatgaacgaaataaaggagcataaacaatggaagattacttagtaaaagcattagcttatgatggttttgttcgtgcctatgcagtgtctgcaacaaaaactgttagtgaagcacaacaacgtcatgatacttggaatacagcatcagcagcgctaggccgcgctatggttggaagcctgcttttgggcagcacgttaaagggtgatgacaaattaacggtcaaaatccaagggaacggacccgctggagcaatcattattgatagcaatggtcgtggagatgtcaaagggtacataaaaaatccgcatgtcagcttgccgctaaacggacaaggaaagttggatgtgcgaggagcagtaggagatcaaggaatctttactgtaatcaaagatttagggttgaaagaaccgttttctggacaaacacctattgtctctggagaattgggagaagacttcacttattacttagcagtttctgaacaaatcccttcggccgttggattgagtgtgttagttgataccgatgattctattcgaacagccggtggtttcttactgcagatcatgccgggagcagatgaaacggttattgattcaatcgagaaccgcctgcaagaattaccacgagtgtcatcattgctggatgaagggaaatcgcctgaagaaattttgacggtattgttgaatgacaccaaagtcgaagtgttagaaaaaatgcctgttcaatttcgatgtgattgtagcaaagaaaaatttgcgacagcgatcattacattaggcgcggatgaaatacaagaaatgatggatgaagatcatggtgcagaagctgtttgttcattctgcggtaataaataccatttcgatgaacaagaacttgctagattaaagaaagaagctgaggcatagaagatggcgatacacagctggaaaatcggtaatgtcgaaatccctaatcgagttgtcgttgcgcctatggcaggaataaccaatgcggcgtttcgcgtaacggtcaaagaatttggcgcaggcttagtcgtttgtgaaatgatcagtgattggggaatccaactacgaaacaaaaaaacattagaaatgctttatatagatgaaacagaacatcctttaagcttgcaaatttttggtgggaataaagagtctttggtcgaagcggctcaatttgtctcagaaaatacagcagcagatatcattgacatcaatatgggttgtccggtaaataaaattattaaagcggaggctggtgcaaagtggctattggatccagacaaagtctacgaaatggtgcatgcagtagctacggcaattgataaaccggtcacagtcaaaatgcggatcggttgggatgatgaacatattttcgctgtccaaaatgcgcaagctgctgaagcggcaggtgcagcggcgattgggatgcatggccgcacgagggtccaaatgtatgaaggagcggctaattggtcggtattaagagaggtgaagcaagcaatttcgatcccttttatggggaacggagatgttcggacaccagaagatgccaaacgaatgctggaagaagtcggcgcagatgctgtcatgatcggacgagcagcattggggaatccgtggatgatccatcgtacaaaacattatcttgaaacgggagagctgatcgccgaacctactccacgggagaagatcgctacagccaaacttcatttggaaaggcttgctgatttaaaaggtgaatttgttgcttcccgagagtttcggcagcatgctgcctactatttaaaaggcatttcacgggcagctaaagtcaaagcggcaatcaaccagacagagaataagcaagcgattattgatctgttagatgcatttgtagaaaagacagaaaaacaacctgtcggaaatactcctgagtaaagtaaaatcaagtcgatcttgaacttcggcttgattttttgtggcatcattggcattataagaaggaaacccaagttaagaatggaggaaaactcgtgacagaggaacgacaaaaacaagaagaattaaatgatcaaatgttggttcgccgtgaaaagatggaaaaattacgggaagaaggcattgatccctttggcaagcgctttgaacgtacgcataattctgccgagttgcatgagttatttgatcaacgaacaaaagaagagttaacagagatgaatctttctgcaagtgttgctggacgaatggtgacgaaacgtggtaaagggaaagctggctttgcacatttgcaagatcgtgatggtcagattcaaatttatgtccgcaaagatcaagtaggtgacgaaccgtatgaaggatttaagcatgctgacttaggtgatttctttggtgtctcaggggagatcatgaaaactgatacgggggaagtaacgatcaaagcaaaagaaatcgttattttgtctaaagcgttacgcccactcccggacaaataccatggacttaccaacatcgagcaacgttaccgtcaacgttatctggatttgatcagtaataaagatagctttgaccgattcatgaaacgcagccagatcatcagtgagattcgtcgctatttggatggtcatggctacattgaagtggaaacgcctgttttgcataatcaagcgggtggggcagcagctcgtccatttatcactcatcacaatgcgttagatattgatctatatttgcgaatcgcgcttgagttgcacttgaaacgattgatcgtaggtggtatggagaaagtctacgaaatcggccgggtcttccgtaatgaggggattgatactacccataatccagaatttactatgttagaagcttatacagcctatacagatttcaaagatgttatggatctaactgagggaattatccgcaatgcagcagagaaagttttagattctgctgtgattacttatgatggacaagaagtcgacttggcgagtgattttgcccgcgtgcatatggtcgatgctatcaaacaacaaacgggtgtcgatttttggaaagagatgacaatcgaagaagcacatgctttagcaaaagaacaccaagtggaagtcactccaacgatgacagtaggacatgttatcaatgaattctttgaaacgtttgttgaagaaaccttacagcaaccgacctttgtttatggacatccggtagaagtctcacctctagcgaagaagaatccaaaggaccctcgatttacagatcgttttgaactatttatcgtaggccgggagtttgctaatgcttttaccgaattaaatgatccaattgatcaaagacaacggtttgaagcacaagaaaaagaacgacaagaaggaaacgatgaagctcatggagtcgatgaagacttccttgaagcgctagaatacggcatgccgccaaccggtggtttagggatcgggatcgatcgtctagtcatgctgttgacagatgcacaatcgattcgcgatgtgctgttattcccaacaatgcgttgataattcataaagagagacacacgggtgtttacttgtgtgtttctttttttaccagtagttccctccaaaatgactaacaagaaaaaaacaagggagaaactcactgctaaatggaacgaaaacgaattaaaaacgaacgatgaattcattggattgtaagaatgaacgcctttgagaaattacgaaaataagagagaaagttattgacctgacagcatttagttggtatattattacatgtgccaaatgacaaaaatcatttctaaaagaaaatgaaaaaagttattgacgccagaaccaacagatgatattataacgaagtcacaaatttaagaaatcaatttgatgctgatgcagcaacaaaaaagattgaaaaaagttgttgacaaataacaattcatttgttattctaatgaagtcgctgatgacgcacaggaagttgttgaataaacactttcgaaaaaaacttttaaaaaaagagttgacattcacttgttgatctgatatgatttaaaagttgctaacgcagcgcagtagacctttgaaaactgaacaaagcaagcaaacgaaccaatgtgtagggcgcttcatttatgaagcaaaatacatgcaagcaatagctagcaaagttaattttatttgagcttaacgatcctatggatcgttcaaacaaatcattatgagagtttgatcctggctcaggacgaacgctggcggcgtgcctaatacatgcaagtcgaacgctttttctttcaccggagcttgctccaccgaaagaaaaagagtggcgaacgggtgagtaacacgtgggtaacctgcccatcagaaggggataacacttggaaacaggtgctaataccgtataacactattttctgcatggaagaaagttgaaaggcgcttttgcgtcactgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtagaacgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcgaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaatagtacggaagactacacatcgtttgcctttgttcagttttgagaggtttactctcaaagataaatacccggggccttagctcagctgggagagcgcctgctttgcacgcaggaggtcagcggttcgatcccgctaggctccattaacgacagaggtcgttaagtttgttcattgaaaactggatatcgaagaaaatcaaaacaagtaacacacaccgagttgacaagttaaagagttttttaataagttcaacgcttattttcttgagcaaccttctatcgctagaagaagtactcagcgaccgtaaggtcaaaggttaagtgaataagggcgcacggtggatgccttggcactaggagccgatgaaggacgggactaacaccgatatgctttggggagctgtaagtaagctatgatccagagatttccgaatgggggaacccagcatcttttataggatgttacacagttgtgaatacatagcagctgtgaggtagacgcagagaactgaaacatctaagtacctgcaggaagagaaagaaaattcgattccctgagtagcggcgagcgaaacgggaaaagcccaaaccaacaagcttgcttgttggggttgtaggactccgatatggtagttgaaacagatagtcgaaatacttggaaaagtatgtcaaagagggtaaaaaccccgtagatgaaatctggctcacacctaggaggatcctgagtacggcggaacacgaggaattccgtcggaatccgggaggaccatctcccaaggctaaatactccctagtgaccgatagtgaaccagtaccgtgagggaaaggtgaaaagcaccccggaaggggagtgaaatagatcctgaaaccgtgtgcctacaacaagttagagcccgttaatgggtgatagcgtgccttttgtagaatgaaccggcgagttacgatagcatgcgaggttaagttgaagagacggagccgcagcgaaagcgagtctgaatagggcgaatgagtatgttgtcgtagacccgaaaccatgtgatctacccatgtccaggttgaaggtgcggtaaaacgcactggaggaccgaacccacgtacgttgaaaagtgcggggatgaggtgtgggtagcggagaaattccaaacgaacttggagatagctggttctctccgaaatagctttagggctagcctcggaattgagaatgatggaggtagagcactgtttggactaggggcccatctcgggttaccgaattcagataaactccgaatgccattcattcatatccgggagtcagactgtgagtgataagatccatagtcgaaagggaaacagcccagaccaccagctaaggtccccaaataactattaagtggaaaaggatgtggggttgcacagacaactaggatgttggcttagaagcagccaccatttaaagagtgcgtaatagctcactagtcgagtgaccctgcgccgaaaatgtaccggggctaaatagtttaccgaagctgtggagtgcaccataaggtgcattggtaggagagcgttctaagggcgttgaaggtagatcgtgaggactactggagcgcttagaagtgagaatgccggtatgagtagcgaaagacaggtgagaatcctgtccaccgtatgactaaggtttcctggggaaggctcgtccgcccagggttagtcgggacctaagccgaggccgacaggcgtaggcgatggacaacaggttgatattcctgtacccgttgtttttgtttgagcaatggagggacgcaggaggctaagaagtgcagactgatggatatgtctgttcaagcagtgagtcttagtgggagtcaaatgcttctactttcaaggacaagctgtgatgaggagggaaataatagtaccgaagcttctgatgtcacactgccaagaaaagcttctagtgagaaaacaatggcccgtaccgcaaaccgacacaggtagtcgaggagagcatcctaaggtgagcgagagaactctcgttaaggaactcggcaaaatgaccccgtaacttcgggagaaggggtgctgctctaacgagcagccgcagtgaataggcccaagcgactgtttatcaaaaacacaggtctctgcaaaatcgaaagatgacgtataggggctgacgcctgcccggtgctggaaggttaagaggagtgcttagcgtaagcgaaggtacgaattgaagccccagtaaacggcggccgtaactataacggtcctaaggtagcgaaattccttgtcgggtaagttccgacccgcacgaaaggcgtaacgatttgggcactgtctcaacgagagactcggtgaaattttagtacctgtgaagatgcaggttacccgcgacaggacggaaagaccccatggagctttactgtagtttgatattgagtgtctgtaccgcatgtacaggataggtaggagccgtagagatcgggacgccagtttcgatggaggcaatggtgggatactacccttgcgttatggccactctaacccgcagcccttatcgggctgggagacagtgtcagatgggcagtttgactggggcggtcgcctcctaaaaggtaacggaggcgcccaaaggttccctcagaatggttggaaatcattcgaagagtgtaaaggcagaagggagcttgactgcgagagctacaactcgagcagggacgaaagtcgggcttagtgatccggtggttccgcatggaagggccatcgctcaacggataaaagctaccctggggataacaggcttatctcccccaagagtccacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgttggaaatttgagaggagctgtccttagtacgagaggaccgggatggacttaccgctggtgtaccagttgtctcgccagaggcatcgctgggtagctatgtagggaagggataaacgctgaaagcatctaagtgtgaagcccacctcaagatgagatttcccatttctttaagaaagtaagatccctgagagatgatcaggtagataggtcagaagtggaaggccagtgatggttggagcggactgatactaatcgatcgaggacttaaccacgattgaaaaaagcaaggaaactcggaagagttttgattcttcgatccagttttgagtgagcaatacttactcaattgaatagtgtggtggcgatagcgagaaggatacacctgtaaccatgccgaacacagaagttaagcttcttagcgccgattgtagtgaagggtttccctttgtgagagtaggacgtcgccacgcgttttttttaaattatgggggtttagctcagctgggagagcatctgccttacaagcagagggtcagcggttcgaacccgttaacccccatatgagccgttagctcagttggtagagcatctgacttttaatcagagggtcacaggttcgagccctgtacggctcatagtaataacctatgcgggtgtggcggaattggcagacgcactagatttaggatctagcgccttcgggcgtgggggttcaagtcccttcacccgcacttcattgccggcttagctcagttggtagagcatctgatttgtaatcagagggtcgagggttcaagtcctttagccggcatcaggaatacgcggaaatagctcagtggtagagcaccaccttgccaaggtgggggtcgcgggttcgaaccccgttttccgcttttgccatcgcaatcagccggggtggcggaactggcagacgcacaggacttaaaatcctgcggtgagtgatcaccgtaccggttcgattccggtcctcggcatttcttaatatgcgcccatagctcaattggatagagtgtttgactacggatcaaaaggttaggggttcgactcctcttgggcgcgttttagcaacgggaagtagctcagcttggtagagcacttggtttgggaccaaggggtcgcaggttcgaatcctgtcttcccgattatattttcaaaaggggccttagctcagctgggagagcgcctgctttgcacgcaggaggtcagcggttcgatcccgctaggctccatatcatttgaataaatgattttttcgcggtgtagctcagctggctagagcgtccggttcatacccgggaggtcgggggttcgatcccctccgccgcgattattaagagcctggacctttagctcagttggttagagcagacggctcataaccgtccggtcgtaggttcgagtcctacaaggtccattgtggcattgtatatgttggaggattacccaagtccggctgaagggaacggtcttgaaaaccgtcaggcgggtaaaaccgtgcaagggttcgaatcccttatcctcctttactgaactcttgatcggattgtagatcaatgagtccagcttttaattacttaaagcagctattgtaattagtaatttattatcgcgggatggagcagtctggtagctcgtcgggctcataacccgaaggtcgtaggttcaaatcctgctcccgcaattgcttctgttaatacaatagaagcgtcaaataaaaactaaaatatggtttggtagttcagttggttagaatgcctgcctgtcacgcaggaggtcgcgggttcgagtcccgtccagaccgccatgcgggtgtagtttagtggtaaaaccacagccttccaagctgttgtcgcgagttcgattctcgtcacccgctttagtttttattttttgggcctatagctcagctggttagagcgcacgcctgataagcgtgaggtcgatggttcgagtccatttaggcccattgaactatatattttgttacatttggggaagtactcaagtggctgaagaggcgcccctgctaagggtgtaggtcgggaaaccggcgcgagggttcaaatccctccttctccgttttagcggtccgttggtcaagtggttaagacaccgccctttcacggcggtaacacgggttcgagtcccgtacggatcattgcaacactttttggaggattacccaagtccggctgaagggaacggtcttgaaaaccgtcaggcgggtaaaaccgtgcaagggttcgaatcccttatcctcctttactgaactcttgatcggattgtagatcaatgagtccagcttttaattacttaaagcagctattgtaattagtaatttattatcgcgggatggagcagtctggtagctcgtcgggctcataacccgaaggtcgtaggttcaaatcctgctcccgcaatcaaaaaaactaaatatggttccgtggtgtaggggttaacatgcctgcctgtcacgcaggagatcgcgggttcgattcccgtcggaaccgttatggctcggtagctcagttggtagagcaatggattgaagctccatgtgtcggcagttcgattctgtcccgcgccatcttgcgggtgtagtttagtggtaaaaccacagccttccaagctgttgtcgcgagttcgattctcgtcacccgctttagtttttttattttgggcctatagctcagctggttagagcgcacgcctgataagcgtgaggtcgatggttcgagtccatttaggcccattgaattttacttggtccgttggtcaagtggttaagacaccgccctttcacggcggtaacacgggttcgaatcccgtacggatcatgaaagcatcctttggaatgctttttttttatgttttaaaaaaggcaattttaaaagtttttccataaattaggcacagtaggtcaaaatttgttataatcagtccgttgcaagttcccgaaaggattcgcagctgcgaagatgccttgtaaccgaatcgaaatttagggggaatacaaaaaatgacagagaaacatttatttacttcagaatctgtatctgaaggacatccagataaagtggctgatcaaatcagtgatgctattttagatgcgctgcttgctgaagatccaatggcacgggttgcctgcgaaacctcggtgacgaccggattagtattggtctttggcgaaatctcgacaagtgcctatgtagatattcaaaaaattgttcgcgaaaccatcaaaggaatcggttatacacgggcaaaattcggctttgacggtgacactgtggcggtattggtagccattgatgaacaatcacctgatattgctcaaggcgttgacaatgcattagaagtacgcgatgaagcgaatgaagaagaaatcggtgccggagatcaaggattgatgtttggttttgctgttgatgaaacaccagaattgatgccattaccaattgcattgagtcaccgtcttgttcggcgattagcagaactgcgtaaaacgaatgaattgacctatttgcgtcctgacgcaaaatcccaagtaactgtcgagtatgatgatcaagatcagcctcgtcgagtggatacagttgttatcagcacacagcatgatgatgcagtagacaatgaaacgattcgtcatgacgttattgaaaaagtgattaaagaagtgataccagcttctcttttagacgatgaaacaaaatattatatcaatccgacaggacgatttgtcatcggtgggcctcaaggggatgccggattgactggtagaaaaatcatcgtagatacttatggtggatatgcaagacatggcggtggcgcattttctgggaaagatgcaacaaaagttgaccgttctgctagttatgctgcacgctatattgctaaaaatatcgttgcagcgaaacttgcccgaaaggtagaggttcagctagcttatgcgattggtgtagcacaacctgtatcgattcgaattgatacgtttggaaccggaaaagtcagtcaagagaaattgatccaagctgtaagagagaattttgatctgcggccagctggaattatagaaatgttgaatctacgtcgtccgatttatcgtcagacagcggcatatggacattttggtcgtacagatatcgacttgccatgggaacaaacagataaagtggatgctttattggcaagtgtgaaggaataaagaggcgacctctgttgatgtaaatcaatagaggttcttttttttgacttagaagagggggagaatgatgaaaacgaatgtgacacgtgtgacgattgctgtttttgttgcaacatttatgacggctatcgaagggacgatcattacgactgctatgccgacgatcgttggttctttacacgggatcgagatcatgaattgggttttttcgatttacttattgactagtgctatgttgacacccatttacggtaaacttgccgataccattggtcgtaaaccgatttttttatttgggacactgctctttatgattggttccgcactctgtggcttgtcaaacagcatgctgacactcatcctttcgagagctgttcaaggaatcggggctggtgcgatgatgcctgttgcattgacgatcatcgccgacttgtaccctgtagaaaagagagcgaaagtcttgggtttgaacagtactgcttgggggattgctagtgtcgtcggtccattagctggtggtgtgattgttgatacagtcggttggcactggatcttttttattaatgtgccgattggtgtgtttcttcttggcatgatttggttttattttcatgaaaacaaaaagacgaagaaatctgagaaaatggatttacttggtagttttttgatgatggtcacattagtttctctgcttttagggtttcagttactaggcgatcaggggttaagtgttgctgtggtaagcttactgattttgactattgtaacattcctgctgttttatcgagtagagaaaaaagcagcagatccattaattgatttagcgttattccattctagaacttttgtggtagtaaatattgtcgcagcactagctagcggttttttgatgggtatcgatgtgtatatcccaatgtggatgcaaggagtcttaggaatgagtgcaggtatcggtggtcttgtactagcaccgttatcgattttatggatggtcggctcatttctagccagccgctggttgctgaagcggtcggtttcatgggtcctaacggctagtctattaattacgcttgttggcgcaatctggctttttattaccccaatgaaaacgtcttttctctggtttttaggaatctcttcaattaccggaatcggattgggagcgacgatggtcgtttgtaccgtgactgctcaaaccagtgttcctcattcacaaattggggtagcgacctccttcaatacgctattaagaacaattggtcagacaatcatggtttctgttttcgggatcgtcttgaatatcagcaataattttggattgaaagaagcaggtattcaagatcaggaaatcatgaatcgcttagtggacccaactgctgctaagaaactttcaacagacattctgcttcaattacgaggaattttgtacgatggattacattgggtatatggattaggattgttgctgattgtgcttgctttggtgtttgcccgtacaattcggcgagaatctggtacaatgataaaaaaagaatcgcaggtgatttgatggcttttatacaagcaaatatctattcaaatgttcttgaaatggaagtaatggtaaacgtgattctcccccaaactaccatcaaaaaggtaggtacaactacaaaaaatgatcaaaaagaattaccagttctatatctattacatggaatgggcggtaatcatagtgtctgggaaagacgaacttcgatcgagcgctatgtgagcgactatcaaatggcagtgatcatgccttcgactgatttggcttggtatacagatacaacttatgatatgaagtactggacctttgttgcagaagagttaccgcaaatctgccgagagctgtttcctcaattgagcagtgatcgagagaagacatttgctgctggtctatctatggggggctatggtgctgttaagttgggtttgcgtaaaccagagagttttgctgccgttgcctctttgtccggggctttagcgattgctgaaagcatggattctcttttaaagattcgaaatacttcttactgggaagggatttttggcccattggatcagtttcaaggttcagagaatgatttgatccatttgatcgatacgattgatccgcaaaaggcaccgcgcttttatattagttgtggaacagaagaccaactgtttcctgcaagtgaatatgcagttgcaaaaatgcaggaacgtgacttggcagtgacatttgagtctggttccggagatcacgattggcaattttgggatcagtggatccaacgggtattaaactggctcgttgaaggaaaataaaaaacatcagagaccgaagaatagtcaacggttctctgatgttttttttcgttcgatacaaaacaggactggtggttggttgcgctgattgatgaattgataggacagcacgttaaattgcgcttgtggtaattgacgacaaaagcgatgaacagcttctaactcttcaggtccgccttcgtggccataatagcatacaaggatgatccgaccgcaaggaacaatacgttggatcaatgcttgcagtgcctgttcggtcgtctcaggtaaagtaatgatttttttatcgctctttggtaagtaacctagattgaaaatagctgcatgaacggcatcagggacgtaatccgctactgtttcatgtccttggtggatcagttcaacttgcggcaggagtccttttgctaacaagcgttcttttgttgttgttactgcttgttcctgaatatcaaaggcatagactttgccttcaggtccgactagtgttgccaacagctcggtatcatggccatttcccatggtggcatcaactacggtctgtcccggtttgacgacttcttgtaaaagggtgtggctataacgcatggctgtttgtagcatagatagcctcttttctaacatcaaattttccttgataggagtcgcggcgcaacatttctttatcgatctcattcaagacttcccattttttgagactccacataggtccaatcaaagcatcccaaggagcgtcacctgtcagacgatgaatgatgatctccgcaggaatcatttctagttggtcgcaaatcaaagagacataagtctctctttgcatcaattgcagcttgccttcatgatagtcccggagcatgcgggtatttcgcatcaaatgcaagagatggagtttgatcccttgaatatctgagtccaagattgttttccgcacattttcccgcatcatttctaatgtttcaccagggagtccattgatcaaatgggtacaaacctgaatgccatgttttctcaatttagcgacaccatcaagatatgtttgataatcatgcgcacggttgattgcgttgctggtggtttcaaaggttgtttgtaaccctaactccacccacaaataaaagcgttggttcaattcagctagatagtctaccacatcgtctggaagacagtcaggacgtgtaccgatagaaacaccaacgacacctggcatggtcaaaacttgttcaaaccgctctcgaatgactgcagctggggcatgggtattggtgaaattttggaaataaacgatgtacttatcgacatgaggccattttttgtgcatcacatcgatttctttatgaaattgaacgggcagcggggcttcaggtgcaacgatcatgtcgcctgaaccagatacgctgcaaaaggtacaaccaccttttgcaacagtaccatctcgattgggacagtcgaagccagcatcgatcggtactttaaatattttttcaccaaattcctgacgcaatgcataattccaagaatggtaacgtttatgctgattttcggcataggggaatgaattcatggattttaccttcttttcttttttctaagattgtttttgttggaaacgccagacaaaacgcttttctaaatagtacggataggtcagtaacagccaagagagtcccacacaaaatccgccgagtacgtcgctaggaaagtgaacacctagatagatccgactgataccgatcagaaaaatcagtaagccaagcaagattctcataccccagcgtaacgcttgtgactggaaaaagacaggaatcagcaaaagtaaggttccataaaataccatgctgccagtggagtgtccgctaggaaaactagagcttgtctccaacactaaatgttccagtgtaggtctttctcgcataaagaataatttaatcaacggattgaagaccgctgagatgccaatcgtaccgaaactgagccacagtgcttcggaatagaagcgattgataagcaacacgaccaatacaacaatgaaaagcagtccaatcgttactggattagcaaacttggtcacccataggaaaaagtcagtcaaaaaaggataaccgctacggatcaaacgagtgctactttcatcgaaaggattcagccaagttggatagaatttgacaacatagcctaaaaaggcaaaaagcagcaaaaaacagctgccggcgaattgataatacagttttttgttcataaaaaaatcctcatttctacaggcaaacatagtgagtctattataccatttatcttggagggacaaaagacagtggtgcaggggtgtttcttgagggacaatattgtataacaagaaattgtcgcttacttcttctttcgaataatgtacgttagattacaaagagtttacagtttggcgaaaagaaggaaataacttttataaaatcttaagaaattgtatactaaacgtaggaaaaaaatagaagacggaggaacgttcatgaacatgagtttatcgcgcaaagagcgtcgcagagaaggacagtccagtgaattttatcaaacgatgagaaaaagtgccgctgttgtagggacaaccataaccgcttgctcagtagtagcgcctttgctgactccagttcaagcggatgccgtagaaaatactgtggtgagaagtaactttgctgcacctaatacagcagcattcattacagaaatcgcaacttatgcacagcctgttgcccaagcaaatgatctttatgcttcagtcatgatcgcacaagccattcttgaaagcggctggggaagaagtgccctgtcccaatcacctaaccataatctttttggaatcaagggcagtcataatggtcagacagtctatatgaatacagcagagtatttaaacaatcaatggttgactatgaaagaacccttcaaaaaatacccttcttacaaagaatcttttgaagacaacgcacgaacattaagaaatgtttcgctaggaaacggtaattattattatgcaggtgcttggaagagcaatacgtcttcttaccgtgatgcaacccaatggttgacggggcgttacgcaacagctcccaactatgcttcttcattgaatacggtgatccagcagtatggcttgactaaatatgatacaccagcttcaggcaatgccggtggtggagcaacggtcagtacgcctaataccgctacaaatcctgtcagcaagccagcagcgacatcgtcagtttcttctggtagtcaaggctatacagttgcgtcaggggattctgtctggggaatcgctaataaattcggcatcacaatggatcagctatgtagctggaacaatattcgcaataattttatctacccaggacaaaaactgacgatcaatggtggtactgccaaacaaacgacgaatacagggaccatatctaccacgacagcaagtgctggtagttatactgttgcttcaggggactcggtttggagtgtggcgaacaagcatagtatcacgatggaccaattgcgcaactggaacaatatcaaaaatgactttatttatcctggtcaacacttagtcgtaaaaaatgatactgggtcaaaaagtcaggccaacaagactacagcaataagttctgtaaccaatgctggtagttataccgttgcttcaggggactcggtttggagtgtggcgaataagcatggcatcacgatggatcaattgcgcagctggaacaatatcaaaaatgactttatttatcctggtcaacgcttagtcgtaaaaaattctggaaataaacagacaagtagcccgaccacagcttctacgagcatttcttcatcagctggcagtcaaaagtatacagtggcgtctggggactcggtttggtcgattgctaataaatttggtatcacgatggaccaattccgcagttggaacaatatcaaaaatgattacgtctatcctggtcaaagcgtacgggtcagcggtacggcaacggctgcgaatcagacggcaagtacgagcaactataccgtagtatctggcgattctgtctggggaattgcggataaatttggtatttccagagatcaatttattcaatggaataacattaaagacaactttgtttatcctggccaaagcgttcgcgtaaaatagattgctattccgctgtttttttgataggataagtgcaaagaatctttcacatttgagaaggaatagtagaaacgtgttggaatcaagagagtgcatggctggtggaaatgcacagaagacctttcgaactcgccttcaagtgatatttgactgaaatgagtgtttctcagaaccgctcaaagtaggcagatacggcgatggtcgttaacacatcgaggtctgtttcataacagataaaattaggtggtaccacgtttataacgtcctataaaaatcaatagtgatttttataggacttttttttaagttctgctgatttttgatcaagtcagagcaccaatttttaggaggcgtccatagtgaactacaatcacaaagaaattgaaaaaaaatggcaaaaatattgggctaagaaaaatgagttcaatacccacgatcaaccggataaaccaaagttttatgcgttagacatgttcccatacccttctggacaaggattgcacgtagggcatccagaaggatatacagcgacggatattctaagccgcttcaagcgcagccaaggattcaacgttcttcatcccatgggttgggatgcttttgggttgcctgctgaacaatatgcattggataccgggaatgatccggccgagtttacgaaaaaaaatattgaaacattccgtcgtcaaatcaattcactggggtttagttacgattggaatcgtgagatcaacacgacagatcctgagtactataaatggacgcaatggatttttaccaaactttatgaaaaaggattggcttatgaagccgaggttcctgtcaattgggttccagagttaggaacggttatcgccaatgaagaagtgatcgatggcaaaagtgaacgcggcggctacgatgttattcgcaaacctatgcgtcagtggatgttgaagatcacggcttatgcggatcgcttgctagatgatctagaagaagttgattggcctgagagcatcaaagaaatgcagcggaattggatcggtcgttctgtgggtgccaatgtcaccttcaaagtagcgggtagcgatgcagcattcaccgtctttacgacacgaccagatacattgttcggtgccacttatacggttttggctcctgaacatgagttggtacaagccatcactacaccggagcaaaaagcagcggttgaggcatatgttgcagaaacagcgaagaagtccgatttgaatcggaccgatttgtctaaagaaaagacgggtgtcttcacaggggcctatgcggtcaatccagcgaatgggaaagaagtgccaatttggattgctgactatgtgttggcttcatatggtactggtgcgatcatggctgtgccagctcatgacgaacgtgaccatgaatttgcaaaagcttttgggttagaaatcattcctgttctggctggaggagacgttgaagaagctgcttatactgaagacggtcctcatatcaattcagagtttctggatggtctagataaagaagcagcaattgaaaaaatgaaccactggttagaagaacaaggagtcggtaaaaaagaaatcagctaccgtctgcgagactggctgttttctcggcagcgttactggggtgagcctatcccgatcattcattgggaagacggtactacaaccactcttccggaagatcaattgccactacgcttgccaaaaaccgataatatcaagccaagtggtacaggtgaatcgccattggcgaatgtcagcgagtgggtcaatgtcgttgatccagaaacaggcatgaagggacgtcgtgaaacgaatacgatgccacaatgggcggggagctcttggtacttcttgcggtttatcgaccctcacaataaaaatcgcttagccgattttgacaaattgaaacgctggttaccagtagatatctatatcggtggggcagaacatgcggtgcttcatttactttatgctcgtttctggcataagttcctttatgatcttggtgtcgtaccgacaaaagaaccattccagaaattattcaatcaagggatgatccttggggaaaacaatgaaaaaatgtcgaagtctcgcggaaacgtcgtaaatccggatgatgtcatcgaacaatacggagcagatacactgcgcatgtatgaaatgttcatgggtccattagatgcatcgatcgcatggaatgaaaacggcttggaaggcagccgtaaattcctagaccgcgtctggcgtttgatcgtggatgaaaatggcaaaatgcgtgatcgaattactacattcaatgatggcaaactaagtaaagtttacaaccaaacagttaaaaaagttaccgaagattttgaacagcttcatttcaacacggctatttcacagctgatggtctttgtgaacgaagcatataagtccgatgcactaccatatgaatatgttgctggatttgtccaattgttggcaccgattgcccctcatatcggtgaagaactatgggcaattctcggaaataaagagggcatctcttatgtgccatggccaacttatgatgaaagtgcgctagtcgaagatgaaatcgaagtggtattccaagtgaacggcaaagttcgggcaaaagccaaagttcctgcggatgcagacaaagcgacgctcgaacagttagctcaatcaaatgaactggtaaaagaacaattgaatggaaaaacgattcgcaaaatcatcgttgtaccaaataaattagtcaatatcgtcgctaattaattgaaaagagggactgtgccataagtctcctacaagtaaaactctccgaacattaactattattgctcctgcggtgcagggactcctcgtcgcaaaagtcagaggaatctatcctagcaatagactattattcggtttaacttgttggatgatgacttatggcacagtccctctaaacatgtctaaacggtcggagcagatgcaactccgagaaataagtcgaaatacccaaaaatttgaaaagcaatttctgtgtattcctccttatttctcggagtttaacacttctgtccccgctttttttgtacaaaaaagcagcggttcagctgatgcaaacatcaactgccgctgcatactattttttgcgaataatgccgtaaaacaatacagctgtagccactaatggaatgaagatcaccaatagaaagccatttggatatgttgcgcgagtgaagatttctgtggaagtatcatttgtgccgatcaagtggtttgctactaaaaattgtccgaccaatgcgatcattgctagaaaacctactgttgcccctgttccaaagaagatttttttctttgtgctgttcattgcgtctgcccctttaatattctctatgtcccattatacaaaaaaatgaaaaagtcttcaatgcgattttgtcaaatcattgattcgtaatacacttgaaatgaatttgacatatttttttagtcagctgactctttctaagtgaaacggcaatcaaatcattcgctgaactaagaggggtctcgtataatagaattaacgcaaatgaaagcgcagaaagaaggaataaaaatggactatcaatcttttgaaggtcaagaggcttttttcaatgattatcaacgagtagcaaaagcaggttaccaagaagaagaagtgatcgatgacgtgctggaacagctgaatcagcaattgactgcggaccagctaatttaccgagtggaagcggaaaaaacgaaagacggcgaagtctttctgtttcctttcagcaaattcatgtataccgaagatttggacgcagcaatctcgacagaatttcgctatgatggtgctccttatgtctatgaaacctatgaggatgaacaaccataattttcagcaaggtatttaaatcaagaactttttaagaggcatttgcatagacacaaaaataaacacccaaaggatgactcgcttgatgctgtcattctttgggtgtttgttgttaacggataggtgaggcaatgaaaaaatcaaagcaaacgctgagcgatctgcaaatcaccttcataaggttctttttgaccattgactttcaaatattgctcagcgcctttaccagctagaatcacgatatcttgactagcggcttcagcaaccgctgattggaccgcaaggctgcggtccatctgttcttcaataatgacagtaggtgcagtgatcgcagcggctatctcggcagcgatagcacgaggatcctcaaagttagggtcatcagaagttaaatagactttatctgcatactcagaaagcgctcgacccatgtcaggacgtcgtgattctgctttgccgccggcactgccggtcacaaaaatcagccgtccttttggccgcaatgtatgggctagctcactcagtgacttaaagcttaagtagttgtgggcataatcaacgatgattaatgcgccattttgtttttccagaacgatcattcgtcctggaatcgttacattaggcaagacagattgtgcttcttcttgggtagctcccgcaagacaagcagcaacgattgcagcagtagcattgtcgtgattgaattctcctagcaaagccaactgatagtcgccattcacaagaagaatatctttttcagaatggatgcggaatgatttaggatcgcccgattccgctggtaatacttgataatctccatcgcattggccataggtgatcaatggtacttgatgagcagcacaagtttcttttaatagttcaaaataatcgctttgtcggttaatgatcatttgtttactattgtggatcaactcgcgtttgcagaaaagataatcatcaaagtccggatgttctactggaccgatatgatcgggcgaaatatttagaaagattccaatttcataagtgatcccagagacacgtttggttttataagcttgggaagagacttccattactagatgtgtcataccattagcgactgcttcggccatcatagcatacaagtctaacgtttccggagtcgtcaaaactgcttcctgatagttctttccgtcaacagtattttcttcagaggagaaaaaagctactttctgattggttgttttggctaaaatctcccgcacaaaataagcacagctcgttttgccttttgttcctgtgattccaattttaaacagctgatcttgcggattgttgtaaaaagcctgggcaatacaagccatggctgctcggatatctgtaacgatgatgccataggcggaacaattttcataagggtgttccgaaacataacattgaagaccctgagcaacggcactttccaaatagctttctttgaacgcggcacctttacagaagaatagcgtatttgcgtctgtctgacgcgaatcataacttaatgaggtaaagatcaagtcgttcatttcttgtggaacggtataatgccattcttggccgataaactcttttaatagatttgcttcgatcaacaacccgcggatctgatggggggtaatggtaagtagtgacatcttggttctcctcgtttcaaaaagtttagtttattatagcatattcaggcaaatcgaatggaagacagcatgcgattggtcgttcttcttcaataatgtgaagaaactttaatatgttgcaaaaatagattgctcgaagtcctttttcgaattaaaatgaaggggatatgtttgtagaaagttggagagaactgccatggataatcatacgcaatctgcgtcaaaacaattaacgacacaagaaaaaatggctcaaggatcggcttggatgacactgggaaacattggttctcggttgctcggtgcgatctatattttgccgtggtactactggatgggagccaacggagataaagcaaatgcattgtttggaatgggttacaatgtctatgctttgtttttgatgatttctactgcaggaattccagcagcgattgcgaaacagatttcctactacaactcaagagaagagtatcgtacaagtcagcgcttgttcctgagagctttacagttgatggcaggatttggggtagtaactgctggtatcatgtacatagccgctccttggctggcaaccgcatctggtggcggagaagaattgattccaacgatgcgctccttaagcgtggcacttttggtctttccatgtatgagtgtgatgcgaggatatttccaaggaaatcaagacatgaaaccattcgcgatttctcagatcgttgaacagatcgcccgagtcttctatatgctgttggcaacgtttattatcatgcggatggtagaaggcgactatacagctgctgtgactcaatcaacgtttgctgcctttatcggcgttttagcaagtgttctggttttggtttattatttccagaagcagcgggttcggatggatgttttgctggacatgagcaaagaagaaacagagatccaaaccaaagaattggttttatccaccatcaaagaagcgattccttttattattgttggttctgggatcacaatttttaaactagtggatcagtatacctttgttcgaattatgaaaggatttacacaatattccaatgatcagctcttagacatgatggcaatctttggcagcaatccagacaagctgacaatggtcgtgatcggcttagcaacgtcgatggcatctacagggttgcctttaatcagtgaagcagtagcgaaaaagaatcaaggaaatttagctaaattgatcagtaataacctccagttgtattcctttgtcatgctgcctgctacgtttggaatgatcgtattggcgtatccattgtatacattgttttatcgaccggatacattaggggcaagcgtcctcgttgctgcttgtatctctggcttaatcctgggcttgttcatgctgacttctagcatgctgcaagggatgtaccataacacagaagcggttatcttcttctttattggtttgttgctaaaatttattttgcagtatccggccatctggctgttccaagtttatggtcctttagtctctacaacattggcacttggtgtgacttgctggctgaatattagaaaaatgttgactaaaggccacttcaatgccaagttgacctttagaagaacggttttgattttcctgatgactctcattatgttagtgatcgcgctgattgctcggcaattgtttggtctggtcttaagttcggatcgcaaagtccaagcctttattctttctctactggttgcagcagtcggtggcggggcctatatttatatggcattgaaaatccgcttagcagaaaaactactgggctcatcaatgattcgtttgcgtaagaaattgcgaatcaaataacccaataaacctgattagccgctgagatcgcatggatcgatcaggcggttttttcagtaaaaaagatcgcaaagagagaggcgagaaaacatgcgactagataaattcttagcagatatggggtatggctcacgaaaagaagtgaagcaagcaatcaagaaaggcgttgttgcggtcaatggtcaacaagtcaaaagtgataaattccaagtagctgaacaagaggatcaggtttcgtttgcaggagaactggtacgttaccagaaagatttctattatttattgaacaaaccggctggtgtgatttctgcaacgaccgatccggaaaagacagtcttggatttgtttgcggcggaagattatcgccgggatctttttccagtcggtcgtttggataaagacaccgaaggactactgctaattacgaatgatggccagctagctcatcggttattgtcacccaaaaaacacgtcgaaaaagagtattatgcagaagttcgagggatcatgaccgaagaggatcgtcaccaatttctccaaggaatcgaactggatggggaaactctcatgccggcacagctgacgattttaaaggtagacgagcaggccgagacatccacgattaccttgattttgcatgaagggaagtttcaccaagtaaaacgaatggtgcaggcagtgggaaaagaagtgacttatctcaagcgtactcgaatgggcgggttacagctgccgaaagatttggcattaggagagtatcgctcagtgacagaaaaagagctggcacagctttctgctgaaccagcggaagattgaattgttgcagcgaatgaagcctgacggctgtgcccagtatgtggaatgagactagaggcaatgtctctgctgcttcagaaacattctgtccatcaccagagcccaggcagcgctttgatctgcagtgactcttgtgagaatggatgggtcaaataaagttcataggcatgcagctcaaggcgagctgcagtttttttctgataaagagggtctccgacgataggatgtccaatgctagcaaggtggacacgaatctgatgcgtacgtcctgtatctaatacacaatagatcgaagtcgtttgggcattgcgagcggcaatctcaacgtgtgtcaccgcagataagccattgcgtgggtcaatgactcgtttgcgacggtcgtggcgatcgcgtccgatttttttgcgaatggtttggttttgatccaattgtccccagactgttgcttggtagcgacgataaatttgcttactttcaagcattcgtcccaaaataggcaagactaaggggtttttagcaaataaaatgacgccgctggtctctttatctaatcggtgaacgacatagggtcttgtctctggtgaaagatatgcagccagatcattcataagtgtgtcggtttcatttggttggttggggtgggttttgataccagcgggcttattgacaacgatcagatgttcatcttcaaacaacaccgtaatcttctctttgttcccagaaatcactggctgatacgtgtaatctgcttcttctagaagaagcgtgagctgatccccacctgctacttcctgatgaaaaagggctgtttcaccgttgacgcgtacatttttgcgggttcgcagtaaatggcgtactttgcgagggacgagccattcttgttctaataattcccgaatcgttgttcggggatggtcattaggtaatgtaatggtatattccataaaaatccctttctaagttgtgatctatttgctattatagcatctttaagattttcttataaaaaaaacaacaaaaaacagaagtttcgctgatagaattgacgagcaatcttttgtggatgaaatttactgctagagccgtattccaaacggtttgatatatgctacactttgttaaaaggagcgtggagaaatggatttgaaacaaatccttcacaagataaaagaatcgatccaaactttctggcgttggatcaagccttatctacagcaattccatcaatggcgcaaacgcatttggaagaaatatcatgtgaataaaatagttattttactgactttagtgggtattttagtgatgagcggttacttgttttatatcgccaagaataccaaagttagtgaattagaatcaggattgaaagagtccactgtgatctacgatgctaaaggagaagaagctgggcagctctattctcaaaagggcacctatgttgatttaaaaagcatttccccagcagtcgttcacgcactgatctcaacggaagaccggaatttttataatcaccatgggtttgatatcaaagggatcgctcgggcggccttgcggatggtagtcaatcgtagtgcagaaggtggcggtgggagtacaattacgcaacagctagcaaagaatgcctatctttctctcgatcaaacctttagtcgaaaagccaaagaactgtttctagcgattgaaatcgaaaaaaaatactcaaaagatgaaatattggaaatgtatttgaacagttcctatttcggtaatggagtctgggggattcaagatgcttcgctcaaatattttggtgtcaatgcttcagatttgacggtgggagaagcagctaccttagtaggtatgcttaaaggtccatcaatttataatcctatcgatcatccagaaaatgcgacgaaccgccgagatactgttctaggactgatggtggacaacaaaatgctggatcaatctgtggccgatcaagaagagcaagtttcaatagctagcctgttgtacgatggctatggcaattcagaatctggctataaatatccttattacttcgatgcagtgatcgatgaagcggagtcttacggacttgatgcggatgatgtgatgaatcgtggatacaaaatctacacagcactggatcaaaactatcaggcacaaatggaagctgcctataaaaacgatgcgctctttccagaaaatgcgtctgatggaacgatggtccaatcaggttcggtggcattagatccgacaactggcggtgttcaagcattggtagggcgacgaggcgaacatgtttttcgcgggttcaattttgctacccaaatgaaacgctcgccaggttcgacaatcaaacccatcagtgtttatgcacctgcaatcgaagcgggctataatccagatagtattttggaagacaaacctcaaagttattatgaggcaaagaattacgatgggacctattccggtgaagtgccgatgtatcaagcattggctcaaagtttaaatctgccagctgtttggacacttcatgaaattggtctcgaccgcggatacaaaaagactcaggaatttgggctaacattgtcagaatcggacaaatattggggattggcgttaggcggattggaaactggcgaatcaccgttgaccatggctgccgcgtatggtgtctttgctagcggaggctattactaccaaccgcatttgatcaccaaaatcgttgattcaacgggcgcggttattgtagataatacttcagtcaaaggaaaacaagtcatctccaaagaaacagcagacaagatgacaagcatgatgctgggtaccttctctaatggaactggggtcagcgctagcccttatggctttacgatcgcaggaaaaaccgggacaacggaaacaaactttgatttatcaaaagtcaatgatcagtggatcgttgggtatacacctgatctcgtaatctccacctggctgggctttgaacaaacgagtgccgaacactatttgactggaaccagcgggcaagtcgtcggcaagatatttaaagcggaagccgaaagtctgttgccttacagccaaggaagtcagttccaagtagcagatgcctatatgactggtgggaaactgatggcagcagatgaagtgccagatccaaatgaatcaacggacaacgatgactggaaaaaatcagttgacgagtttgccgaaaatgccaaagaaggattaaaagattttggtgagcgtgtcaaacaaggaaccaaagagctttttggtaatctatggaatacgatcaatggtaattgatgttagcttctactgcatgtgcatccgaacagtatgttataataagaaaaaaacaaagtgagggaacagtatggcaaatatttatgacacagcgaatcaattagaacgagaattacgagaatccgaacagtttcaagatttaaaagcctcgtttgatcgtttgaaagaaaaccaagaagcgtatagcttattcaaggagttccaaggcttgcaacaagctttgcaacaaaaaatgatggcaggccaagaaatgacagaagaagaagcacagcaagcacaagaactctctcaaaaaattcagcaagatccaatcgtttcggaattgatgcaaaaagagcaagcatttagtctggtggccaatgatttgaatcgaatcatcatgggccctgtgcgggacttatacgaagcctaagcgctagcctgctgacttaccgcagcacaaaagagtccaagaggggttctcaaacagaggcctcggacttgtgccaattctatgccaatttacagtgctttagatagcgttagaggctaatttgagcggacaacattcgaaggatcggggacttcctcgacccttcgaattttttgttcaaaaaggcgaacaaattttcgtgttttgctgacgaaaaaacaaagaaatgttatgatagaagcaaaagggggaaaggtatcatgcgttttttacatagtgctgacttgcatattgatcgttctttcgaagggatccgcatgttatcggataacgtcaaagagcagcttccgctgatcaatcgaaaaataatcaaaaaactggttgatacggcactggagcatgaagtggattttgttctcttggcgggggataccttccaccaagcccgtccaagtctgcggatccagcatgacttttttcaagagatttcccgacttgcgtcagcagagatccctgtctatatgatctttggtaaccatgattactatgatccgcagcgttattggtttgattttcctgagaatgttgtgctgtttcccagtgagacggttgaaacgatcaaaggcgtaaccagaaatggtgagacctatgctatcagtggctttagttatcagcagccttggattacacagaacaagatcagggaatttcctaatcgccaagcggttgatttccatatcggtatgtaccacggggatagtgcgggggaacattatgcaccattttctgtgagtgaaatgaagcagaaaggctatgattattgggcactaggtcatattcatgttcctaagatcctttcagaagaacctgcgatcgtttatccagggaccccacaaggcaaaacgcaaaaagaacaagatacaggcgttgttttagccactttgagttcccatggtaccgagatccagacggtcgacgtagcagaaatcacatgggcacaacaagaagtctcattagcagcttgtaaggatcagcgttcgattttgcaaacgattttgaaggaggtcaacacgaatcagccacgactgatcaaattagtgctgacagatacggatcagttatcttcagattggttttctgaaaccgaaaaaaatgaaatgatcgcctatttgaacgagcagctgtcaagagacgtattacagacaatttatgcaatcgaagtctacaaaacagagacagacaaaattccattagcgatcccggcgtcctatgttgatcaattactagctatttatcaagacccgtctatttttgctgaaggactgaatgatttgcttcgtcatccgttgctttatcgcgggattgatcaaggtgcctttcaagaagaggtcttacagcagacgaaacacttgctggagaatgatttccagtgggaggaagaagtatgagaatcttaaaagcagaaatcactgggtttggccgttaccatgatcaagtgattgaattttcccaaggaaatcaattgctttttggcaacaatgaaatcggcaagtcgacattgtatcagtttattgcggctatgctgtttggttttcctaaaagaacagctaagaaaaaggattatacccccaaaaatggggccgcttatggaggcagattgtggctagttgtcgaaccttacggggaagtgatgatcgaacgttaccgtcaaatcgatcgaggaagagccaaagtccatttcaacgggcagaccggcgacgaggaaatgctggcacagttgctgcaacccttgaatcagacgttgtttttcgatgtatttacttttcagcaagaacaacttgcccaaattgacaagctgcaagaaaatgaattgcatcaagcactgatttctttgggaatcagtgggagtcaaaagatgctgcaacaagtggctcgctatgaagcaatcaatcaacaaaattataaaccgcggggacaaaaactccctttgaaccaagcgttgaaacgtttggagaaactacaggagaaaattgcccaaaaagaaagcgaagaacatcgcttgcaacagcagtatcagcagatttcacagattcaaaaagaattgcggcaattagaagaacagcagcaagtgcaaagcgatgcttatcaagctgttcaacaacagatcagccattggccattgtatgaagaatggcaacagctatcaagccagccagctgcagtagcagaaaaagacgctcaggaaatcagcagattttatcagacctatcagcacttaacagaagatattcatcaaaaagaagcagaacttgatcgtttggaacaagggcaagcttcagataaatatttcttttatctggacaacgaacatttgatcactcagatccttcagaaacaagttgagatggcccgattgatggatcggcaggaacaggcgctagaaaaggaacaacaagcacgaatggcgttgaaccagctgatcaatagacggcaatggtcaaaagaatcaccaccactgcagacagaacaaatccaggaacaattaatgaatctggagcaaagcgactaccagttagaggaagcaaacaagcgcttagagtggttagaagagaaggaaaatcatcttcaacatgctttatcacggttggaacaggcgcacccaggattgatgggagagcaaaaaatggctattcctatggtgccattagtaggtggtttggttgcttgtgttgcagcattctttttaccgtctccttggcgctggttgtgtatagcggctggcaccgttggtattggactagcaatttgggaggcaatgaaacaacgtcctcataaacaaggtgacagcaaaaaacaatggcaagagttattgttgcaaacggatctggttgcctcagagatcgcagatctgacagaagccaataatttacaaaaacaacagaatgaacgatggcgtcaggcgctgcaacctttttttggcacggaaccttatcacagatggtcggtcttcttgctgcagtaccaagaggatgttactaattatcagttgcatgctcatcagcttcgcgaagccaaagaacaactgcaagaggtcacagaacagcttcagccttatcaagcgatgtttacaccttttgctgattggttgcccctgcaaaataagacaatactggagcaggctcagctattgcatgaattcaatgaagagatgcaggctgttaaattggcgcgtttacagcagcccagcacgttgttggcgcagcaacttgctcgcaaaaaggcggagcgggctgaattgttgaaggcttctcaagagattctctcacaagttggcattgatcagccagcagaaatcagtctttggctcaaacaatgggagacgcatcagcgggcggcaaagcgggaagccgaattagcagtcatgctggatccgattttcccggaaccaatcacacaagaagaattgctggaaaagaaaacgcaagtggcacaaaagcaaaaagagctgcaccagcttagtcgacaaaaggcagagcaaaggcaacggcttgaactagaagtagccgccagccaaaaaagcggtacgttgagccagctctatcaggaagaaagcgaactgcgggcaaaaatcgaggaattggctcttgcttggagcagtcgacaattagctgcttcggtattgtccgatttgacgactgaattgtctgagcaacaattgccgcaattactagaaaaagcttcgatatatttcagattgctttccaatgactgctatcaccaagtaacactgcatgaggggcaattagttgccagcaatgctagcgatagttactcgatcatcgatctatcaacaggaacaaaagatcagctgatcatggcgatccgcttcggttatcttgcgttgcaacaaaatcatcctcttagtcccatcattatcgatgatggctggttgcattatgatagtgcacgaaaagaacggttagcggaattattcgctgagtttggccaatattaccaagtaatttgtttgtcttctgaccaagaaatggtaagctattatcataaataccagcaatccgtacaagaacttagtcaaaggatgtgagaaatttggctatgcgccaaatgttaacatgaaaaaaattcgagaattgaccgtagatgagacgtttcaactgtttttgttgattaaaaatgcggatgttcgtatcgcaaaaaatggcaaaaagtttatcgcgtttacttttcaagatacttctggaacaatcgacggaaagttttgggatgcttctgaggaagaaatcaatcgcttcgaggctggtaaggtcgttttattagatggaaagcgagaagtttatcaaggaaatccccaagtcaagattttgcatctgcgtctggcaaaaccagaagaacctcatgacccgagccagtacatggaaagagcccctctgaaaaaagaagacatggaagaggaaattaatcagacattgtttgaaatcaccaatcctcattggaatcgtatcgttcgttttttgctgaataaatacaagaaagaattttttgattttccagcagctaaacggaatcaccatgcctttgctagtggattggcttaccatacaacgaccatgttgcgaatcggaaaatctttgatcaaagagtatccggaaatcaatgcaccgcttttgtatgcaggaattatcctgcatgatttaggaaaagtgattgaattgacgggaccaatgaccacagagtatacattagctggaaatctggttggacatttagtgctagtagatgaagaaatcacccaagcgtgtattgctctgaaatttgatgataaacaagaagatatcgttgtgctgcggcacatggttttggctcatcatggattgttggaatatggctcaccagttcgcccaagaattatggaggcggagatcctgcatcaaatcgataacatcgatgcttctatgcaaatgatgttgtcatctattcgcttaacggaaccaggagaatacactgagcggatttttgggatggataatcgtagtttttatgtgccgaaagatgtataaataaaaaaagattggcttttgccaatcttttttttctgttatttttcagaggaatctgtagcagatgaactagttgtttcagttgattcttttgtagaattagttgcattctctttgttatctgatgcatctgtagcagaagaatcagttgaatcttttgtttctgctgcagaaacatagtcagaaagaatatcagctagatcttcatctttcattttcacattggcagctttcagttctttaccaatcgtttttgccacgaatgtagaatcgttcaatagcgtgttttgtgcgatttctgtgatttgatctttgtatttatccatgtcgttgcctttgtcttggtttttgaccattttgacaatgtaatagcttgttgtataagtagaagcatccgtagcagaaatgacctctgaaatttcaccatcttttaatgcaaaggcagctgtttgtacttcagctggcacagttgttgaggttgagtcgaatttgactgtaccgccatcttctgcagtcgctgtgtctgttgatttttcttttgctaatttactaaagtcagcaccatctttttgagcttcttttaatacatcttttgcatcatcttcactagtcaatttgatcaattgtgcttcaacttctggatggaaagaatcccaagctgctttcagctcatcatcaccaatatccatgttcgcttttagcccttcttgtaatgctaattgctgtctgatttgttcacgatagctttttttagtaagtccagaagcttccaatgcagactcaaatttatcactgtcgccatattgtttcgcagtttgatcgtattgcttgtcgatcattttctctgtaacatcatccccatatttttgatcgaagacttttaagacgatcaattggcggataagactttggttattctgatctgtttttgcttgttcgtaaaaatcttcaaccgtgattttaccgcctttcatggttgcaatctcattacttgaacttccggaacaagcagctaatgtcaaaacgctcagtgcactgactgctgctaaaatcaattttttcttcattcgtttaagcactcctattttctaaatatttcaaagaatcacagctaatactataccacactctttttttaattgggaagaaaacaaatgatgtttcaaacaaaattcatagattctccaatatttgctacttattttcttcttggggaactgatttggcttgtatcgtcgtgacatgttggttcaaacgatccacgtgggtctttatccgctcgattcttggctgtgcttggaatttgaatgattcaaaatcttttgtgaaagactctttgacaacaggaatcgtttcgtcaaccgttttacgcgtcaatgtgacagcatcttttaagtttttgacactttcattaaactcaagagtcgcttccgtggtctcatcgacataacgaagcatttgttcacgggtttctttaccgctttttggtgcaaatagcagcccgcctaagccgccggcgagagagccgaataacaaacctttgataaagttaccgatcatttagtccaccagctttccgattttttcagcgatctctgttagctgttcctgtgagtaatcctctgcatgattaccgaaatgcatcgagaaatcatctttttcatcgtaacgaggaatcaaatgaatatgggaatgaaaaacagattgataagccaattctttattgttattgattatgttgagtccattgatctcaggaaaggctttttcgattgcccgagcgattttaggaacgcgagcaaagacctctgcagcaagggcttcatcatactcaaaaatatccgttacgtggactttcggaataactaatgtatgtccaggtgttacttgggaaatatccaaaaaggcatagacttgatcatcctcatatactttgtaactagggatgtcacgattgttgatcttacaaaaaatgcaattttccatttcataaacctccttgttcttctagtcctactttaccatattctgctgatttcggcagtttttgttcttgaattccttcaaaagcaggccatcgcttcttttccatgtaaagtacggatgtttgtggagagaaacgcttgcatttgtccgcttgcaccaatagacttaaaagcagaaatagaaaaggacggatacgatgaaaccaatcattaaagaaacgttacagaaaaaaaagaccaaacgagaaaaaatcagctatcttgcctatgcatataaggagtggctgattgcaggactagcagtcattctagtaggaggttcgctgatctattcgatgacaagaccaaaagaagttgtttatacagtggctgttgtttctgagaccagtgaacagcagcccacacaatctgaatttgaaaaagcagcgacggattgggtgaagcaaaacgtggcgcctgatcacgaaataacagttacatttgtttcctatgaagatccagccgctgtccaagcctttacgacccgtttagctgccggagcaattcaagccgtcatttttgatgcgtccgaagcagacatgtgggtcgagcgttttggtagcagtgagctgccaaaagaaccattgcaagtagctggacacgagtatgttgttcaaataactaataacggaaaatagcagatttcaagaagtagatgactgctctttgaccgctgcttcatggtataatagttgatattggaggaacgaaaatgacattacaagtagaaaatgtaacaggcggttatacacagctacctgttctaaaaaatattgatttttcgatcgcggatggtgaacttgtggggttgatcggtttgaatggtgctggtaaaagtaccacgattaaagaaatcattggtctgctacaacctcacactggaaaaatcactatcaacggactatcgctgaaagaagatccgcaagcgtatcgcaagcagatcggctacattcctgaaacgccttctctttatgaagaattgactttaaaagagcatatcgaagtaacggcaatggcctatgacatccccaaagatgtcgcactgcaacgggcggagcggttattaaaaacatttcgcttagaaaataagttggactggtttccagcaaatttttctaagggaatgaaacaaaaagtcatggttttgtgtgcttttctaattgaaccaagtttgtacatcatcgatgagccttttttgggcttagatccattggcaatcaatgcattgcttgaattgatgaatgagatgaaacaaaccggggcatcgattttaatgtcgacccatatcttggctacagctgagaaatattgtgacaagtttatcctgcttcacaatggcgagattcgagcccaaggaacgctgtcgcaattacaaagccaatttggggctgaaggagcttccctcgatgagttgtacttagcattgacaaaggagagtcagctatgaaggggttcttctcacaacgcttgcaacgacaccagaaacagatgagtcgctatttgcgttatgttttcaatgatcattttgcgatcctcatcacatttctaatgggtggactgggtctatattattcgaattttttaaaaacgctccctcggccgttccctcagggggggatcgtattgctattgatctggttggcacttttgtcagtcggcaagttggcaacattggtgaaaccagcagatttgatttttcttttagctaaagaaaagcagatggcggactatcttgctcaagcactgcgctattcaatgtggctgccttttggggtctcctttttagtcgttggtgcgacgatgcctttagtcgtagtagttactgaacaaacgtttgcgagctttttcttttatttagggacgatttggttattaaaagttacggatctctggttacagcgtttgtctctttatcaaggacaagaacagcgtaacaaccagcgtgttctgtgggtgattgctgcagtaagcagccttttagctagtctgtatgttgcaccttgggttggattgctcttagctgttctacaagctgcttggttcaaccttcagtgtcgtccgacaggtcttctattaggttgggatcgcatgatccacatggaagaaacgagacttcatcgcatttatcggtttatcaacttattcacagatgtacctcaaatcacagcagcagccaaacgccgcaagtatttagatggtctgttgaataggattccttttggacaggaacagacttatcgctatctatatgctcgccgctttttgcgaggggaacaatatagcgggctttttttccgtttgacactgattggtgtattagtgcttttctttgttcaagaatggtggcttagtctagggttaggatgtatgtttctttatttgatcggttttcagctactgccgatgtataatgagtttcagtacatgattttgactcatttatatccaatcgaggaagggcaaaaacagacagccattaattggctattgcttagattattaggcggagctgctttcatttttggtgtagtcggcttgttccgagcggcaattctttggcaaggagtgctagtgctgttgggctttttgttatttacaggactctttttggttttctatgtacctgcccgcttgaaaaaaatgcaaagtcaataaagatggctggacgttactcgaaaaaaccgaacgcatatgcgcttgacgttgactctttaggaagctagaataagagatactgtgaaataaggagagaagctaggatggatattcgcttggatcaagattggcgcctgagaccaatcaaaggcgacaccggcaaagcctacattggcttgaaggacaatgataaagtctttatcaaacgaaatacgaccccgatgcttgcggcactctccaaagaggggattactcctaaacttgtgtggaccaagcgtaccggcaatggcgatacgttgtctgctcaagagtggctagatggacgtgtattggaccccgaagagatcggtcaaagaaatgatgtgatcgatgtattgtatcatttgcaccattccaaaacattagcgaagatgctgagcaaaatcggtggtcaagtgatgacaccagaaaaaatgttagttgaatatgaagaaaacttacctaaagcggttgttcaaaatcgctttattgctattgtttatcgttatttaagagagaatattccagaatttcaggaacaaaaggcctccgtcgttcatggggatgtcaattaccgtaattggcttgtttgccaaaactatctgtatttggttgattgggattcgatcatgtttgcggatcccgcaatggatatcggtacgatcttagggcattatgttccattatccagctggccgcattggctagtgcgttacgggattcatggcagcagtgaagtgatcgagaaaatttattggtatgctttattaagtatgcttcaggaagtaaagaagtactaccaacgcggggattataaagcaatgaatgcagagattctgcaattaaaaagaatttatagtgaatgagaagatggagcgaagcaacaagttccatcttgttttttcggaaaggaaacaacatgagagtaagaaaacgtgcgggagcagaagaattagtccaagcgcatcccgaatttgtagtagctgaaccgacagcgtggaaaggccgttggaaggaacgatttggcaatgatcacccattgcatattgaaatcggtatgggaaaaggccgtttcattaccgaaatggctaaagcacatccggaaattaattatattggcatcgaaatgcaaatcagtgtggtttccattgcactggataaactgatcgaacaagatatccctaatgtgcagctgctgcacgttgacggttccgcattgacgaattattttgcggatcatgaagtcgatcaaatctatttgaatttttcagatccttggccaaaaaagaagcatgagaaacgccgactaacatcgaaagcttttttggcagtcgatgaacaaattttacgtccgaatggtgaaattcatttcaaaacggacaatcaaggcttatttgaatattcactcgccagcttttcacaatatggtatggttttaaaacaagtatggttggatcttcatcaaagtgactatgaaggaaatatcatgaccgagtatgaagagaagttttccagccgcggtcaaagaatctaccgggtagaagcccaatttgtggcaccagaagatacgaccaaaagttaaataagcgagtcctagcgttcagactgtagcacaaggcagaaaatgtctttgttctacagtttttttgtatagaaaagtaaaagctgcgtatctctttttaggagggtgacaatggacatttgtacattttcagatgagttggtggagtatgcgaaggtgcagaaaatgcaagatctatccatactgccaacagtcgaagggatgactctgattttcagcaaaagttactatcggcaaatgtatcgcaaagttactacagaagacgcgcaacaattgatcactcgattcaaatttctgggcggtatggaagtaggagaaaaacgaagagcgcaattaggggctatcagctatcctttggcagatggagagcagcgtatccgggtttcgactgttggggattttcaaggtcaagaaagtttagttctacgttttttgcaccctttaggtaagttccatcgattctttatgaatgaacaatatgaaacgatcgcagatgcatgccgctatcgagggctctatctcttttctggtcctactggatcggggaaatccacactgatgtatcgcttagcttcagctgcagcaggtcaggtgatcacgatcgaagacccggttgagatcgttgagcctcgttttttacagttgcagaccaatccaatgatcggccaggattatgatgagctgattcgtttgtcgttgcggcatcgacctgagctattgctgattggtgagatccgcaacaaagagacggccaaggctgcgatccgtgcggcactgacaggacatcgggtttttgcgacgatccatgcacggggattaacggaaacaattgcgcgattgcaagagctgacagaggaagcagctgtgatcgaccaatgcctccaaggaatcatttatcagcgcttactgccagatcttcacggagtccctcacgcattgatggcctacaccttttatgaaccccacaaatcctcaatgacttgggatcaagcactaacaaggatcagagaaaaggagcagatcacccatgaggtttttgacaaggaaaagtaaacggctttcccgcaaacagacccacgccttattagccacatttacggttttattagagagtggtttctcattacaagagagtttgcttgttctacttcgcagtggccaatttgatccgaatacagtaaaagatattgatcagcgactgaaacaaggtcaacgactcagacaggccttttctttgctgcatttatctgaagccgaacaaaatcagctggacttggcagagacccatggcaatctggtggatacgttgcagcgaatggtcgcttaccagatccttttggaaaaacaaaatcagacattacaaaaagtgttggcgtatccccttctattgctggtatttgtctttaccgctctctttgccatgcgtcggtttctattgcctcaacttctggcctccggtatgatcgatgcgaatcattggggcattctctttattacggcagcaccatggatcggtgcggtcattgtaggcggattgggaggtttcgttcttgttgtaagaggaatctttgccaagcagacagcgttgaagcgagccacttttttgagtcgattgccttttttgggagacttgtatcgctgctatcaaactagttattttgcattagagtggggaaaattgtttcagcaaggcttggaaattcgtcagatcattatgtgcatgcaacaaacaagtacagcaacattagtacaagaactagctgttcaattagagctgtgcttggcaagtggcggattgttgccggacaaattaaaggactatgtatttttgacgccagagttttcattgattgtgttccagggcgaaatgcgtgggaaattaggagaagaattgtttgtttatagtcagcttttgacagatcggcttttccaacaaatcgagaagaaaatccagtggattcaaccagtcatttttttattagtggcccttctgatcgtgggtgtttatgctgcaatgtttttgccgatttacggcaatattcaaggagtgatcgaatgagaaaattgaagcatcaagggttcacattggtggagatgctgattgtactgttagtgatcagtattttgattttattgtttgtaccaaacttatccgcacaacgtacagtgatagatgagaaaggaaatgcggcaatcgtcaaagtcgtagaaacccagattgagttgttccagcttaatgagaatcgaacacctactcgacaagaattactagctggaaattatgtaacggaggagcagtatgcgatttaccttgcccatcggaacgaatagcagtttttttacttggcggggatttacaatggtggagagtttgattgtcctcttagtcgtttcgattttcatctttcttccgctaatagctatcgaccgttaccaagcatattttgaagtgtgggggttttgtgctcgtttggaaaaaggattggcagtagcacaacaaacagcgattattgatgctcgcgaaacgaaagtcgcttattctgattcaccagttcctacgatatattttcattcgacgatcacaggtgaaatcaaaatggagccacttgaagtaccctcgcagctcgcagtacgtgtttttcctgtacttacattcaccagtcaatctggcaattatacgcggatggaaacattacggtttgaatggatggaccaagaaaaaaagattacctacaaatttctttttggaagtggacgatatgataagatcatcgaataaaggatatatcatgctagaaagtatcattggctttggtttgctgacgacgagtgtcttcctttttctgactgtccagacccatattttacagcaaagtgcacagttacaggcccaggtggctgctattcgggtattgtatgaagaagtccaatgccaagcatttgaacaggaagtcgtttattcgacacaacgtacagagtcgtatcagttgtctttcggtttcaagcgtgaccgaagctatggacggattgtaagaggtcctcttatcatggagatcaactatgaagagtaagggttttactttgttggaatgtttgctgtctttaatgatcttaggactcagtgtgttgttgatcaacggaatcattcgccagatgcctcaagttaatcaacagctttttgctcgcaaagaccaagaatggcagatatttttgattcagttagaaagggagcttcaaacgtgtacgtatgtttcagtgagtccgtatacactttttttaaaaagcagcaaagaaaatgtagtcacgatcgatcgaatcaatgggaaagtccgtaaaagagacaataatggctaccatccgttattgacggaagtatcattgatttactttgaaaaaaaggcatcctcgatccagtttacagtgactttcgagaatggagaggtgagaattggtcaatggcagattcctgcataagggcggtatctttttgtcagcaatgatgctgattcatttgctgagccttatgttgctaacggttttagaaaatactcggacaactactgatttctatattaagactcttcacatgtatgaggcacgaatcatgaaagaactttttttggcggattatcagcggttaacctatgccgagcagggcagtgtcaactacaatgtagggagggtcatttacgaacaaaaagaagagctgttgttgattcaatgtgtcgtcaatcagcgcaccttccgttttaccgaaattttgtcaggtgatttggaaaaaatagcaacagatcttgagtaactataatacagaaaaaggcacagacatactgtgtcttttttctgtataaaagagttgaaaagtatgtttgtctcttcacaaattattctgaaagatagcgattgattattttggctgaatcagctaaaattaaacaggtatgtatgttgttatagttttgaaaagaggtgcaagatgtccccagaaaaaatggaagagtcttttcatttatcgctagaagcgattcaagtgctccaaaacgcattagaaacatcttatttggatgcatatatcgagacgatcgagaattttattgatcagtatcgcgtacgggtgatcgacggagtacctagtgaagcggatgctcaacggttggaagcgatttataaaaaattagagcagatacccttaacagcagaagaacggcgtaaacttgctcaactacttctgttaaagggcggacaaaccgaacatctgcagcctaatcatcagctgacaccagatagtatcggttttttgtttgtgtatttgatcgagcaattgacaccagcgaagcaacaaaccaagattctggacctttcggttggaatggggaatcttgtcttaacgctcttgctcaatttgcagttagcgcaaagagatgtgcaagcaacaggtgttgacattgatgaaacattactgagtgttgctgcagctacaagcgaatggactcaagccccgctgcatttgtttcatcaagacgggttgcaagaattgttaatcgacccaatggacattgctgtcagtgatttgccagtcggctattatccacaagatgaaaaagcagcatcgtttcttacttcagctcccgaaggcgaaggacatagctttgcccaccatttattgatggaacaagcaatgaactatgtgaaagaagatggctatggactattcttagctccggctaatttcatggaaactgaacaaagcgattatttgaagaaatggctcaatgaaaaagtttatctgcaaggaatcattcaattgccagacgagcttttcaaaaatgagcgatcaagaaaaagtattgtgctgattcaaaatcatggtgcaacgagcaagcaagcaccagtgttacttgctaaactcgcatctctcaaggaaccaaaaaacatcaagaaatttttcgaacaatttgaagcttggaaagcatcaaatttgtaatataaatcggataaggagaaaattatgtctaaaacaattgcaatcaatgctggaagttcaagtctaaaatggcagttatatcaaatgccagaagaaacggtggtcgctaaagggatcgttgaacgtatcggattaaaagattcgatttttaccatcaaatatggggaagatcaaaaattcgaacaaatcatcgacatcaatgatcatgaagtcgcagtaaaaatgcttttggatcaattgatcgaattgaacatcttaggttcatatgatgaaatcactggtgttggtcaccgtgtcgttcatggaggagaagacttcccggattctgttgtgatcacagatgaagtgatggaacgcattgaagcattggcagagtttgcaccattgcataatccagccaacttgatggggatcactgctttcaagaagatcttaccagatatcattagtgttgctgttttcgatacttctttccacgcaaccatgccaaaacacaactacttgtacagtctgccattggcttactacaacgactataaagttcgtaaatatggtttccatggtacaagccaccgttatgtgtcagaacgtgcggctgaaatgttaggcaaaccgattgaagatttgaaaatcattacttgtcatttaggaaatggcgcatcgatcactgcagttgatggtggaaaatctgttgatacatcaatgggcttcacaccacttgcaggagtgacgatgggtactcgttctggtgatatcgacccagctgtattgccttatttaatggaaaaattagacctatcgatcgatgaaatgatcgatgttttgaacaaaaaatctggtttgttaggactttccggtatttctagcgatatgcgggatcttgaagctaattatgacaaagaagaagtaaaagttgcgtatgatgtctttactgaccgcattcgtaaatatatcggtggctatgtaacaacaatgaacggtgttgatgcaatcgtctttactgctggtatcggtgagaacgatgcccatgtccgcagtgaggttatcaaaggaatgacttggtttggttgtgaacttgatgaagaacaaaatgccaaacgcggcgaagagttagtcatttctacagaagattctaaagtgaaagtcttgttgattccaacagacgaagaattaatgattgctcgcgacgtggaacgtttgcgcggttaattgtcggagatcaattggaacaaatgagtttcattatttgaataaaaaaagtgttaagccttggcttaacacttttttgttttgaacagctgtacaccttggataccaatgaataatgcttgaaagtcgcaaatttggttagcgctattcttatttttctttatattttcagaaaatccaacggtggaactcaaaacttatctagccattttctcatagcttttttgactttggttccatttcgttgtcagaggttgcttggtttaccagcaatccgtccgcaaaggcggccacgtcttcgccagttacttgaagaacacttttttcttgttgcgcattgtcttcaaacaaatccaacagatcaacgagtggttggaaatcgctggcaagatttactggatcaactttcataaagtacttttggatttctttatagacgattcgataatcattcggcaactgatttgcccgtttttgcagagcacgccattcttttttaccttctaatgcttcttttattcccatcttcatccctcactttagttttttggtcacttgattcaagtgttctcgcaatttgtctcgctcatttttggcaccagctgcttcagcgatttctgagatgaaggtagtcatattttcaccgatcacgctattgatcggcagtttttctgcggcactttcttcaaaaagaccgacgatcccttccaagatagggtacagatttcttccagaaaaatcactgtagctccagatcttttgattgtgttcgcgccacgcatcttggtagccagcgggtaacttatcaatacgaagttgaaattctttttgttgcttattcatgtcgttacctgttattttgtcataaaagttcatggtgggcctcctaattaataaatagttgtttgtagcgtttcattgacagaaaagagaaaaaacttagtaatatggctagccacaaaagggtcaagaggctgctttgggaaccaaaagagaatgtaccagcaagcaaattctttgtcgtttcgataatgggcgtcattggctggttctcagcaaataggcgcacaggttttgccattccagcgactggcacaaaggctggactgataaaaagcaggaagatcaaaatatacgaaaaggctcctgctccagcataatcttttgctgttaacgagaaggggatagctagcacagtgagactaacggcaaaaagtacgatcaaaagggtgaaaagcaggaagtcaccaatcgttgcttgtggtcgataacccaatactagtccgatcagcagtacagaaagtacagaaataagcataaaaattgttgaggcgacaatgtgcgatcctagaatcacccaacgtttcattggcatagataataatcgcgtcaggaatccttttgttttatcattgttgatcctcaaagcagtgtaagccgatcccattgccatagacatcagcaaaaatcctggcataacgtagctaagataatctgaaggctctcctgcagtgcccccgactaaaatattgccaccaatgacataaacgaaaaaaagtaagatgaaaataggcataacgatacttgtaatgatcgtatcgacacttgttaaattttgtctaacgatgcggttcgttaatgtgaaaagttgcttgattgtcttcattttttagtcctcctttccagtagcatccaagaatatttcttccaaactaagttcaatcggagcagttgttagaatgtcaatatcattttgcaagagtttcatcatcgactcttttaaatcatttctagcaagaataatggtgtcattttcaatcatatagtgaatcgcagattcgtttagaagagaagtcgcttgatcgatcactttttttggaacgatgactttgtgcagatctcttgcttgctttttcaattcttgtggtgtgccaatcaatgaaatcttcccatcgttgataaaagcgattcgatcagctaaacggtctgcttcatcaaggtattgagttgtcagaaagatcgtctttccttctgctttaagctgaaggattagttgccaaatctctaatctgttttttggatccacaccagtagttggctcatcaagaaacaaaatttctttgtcagggagcagagagactgcaatatctagtcgtcgcttcattcctccagaataggtagcgacttttttatagagaaaatctgctaaatgaagtcgttctgataaggtatctattttcctgcgcagatgagggatgtccaacagcgtgccaattagtttcaaattttcaaaaccggtaaattcatcatctagtgtgatcgattgactattcaagctgatgacatcccgcacttgatcggagtcatttcataggtctaaccctaaaattgttgcattgccggatgtagggctagcgagtgtagttagaatattgatcagtgttgactttccagcaccattttctccaagtaaagtaaagatttcgcctcttttgatttcaagagtaattccttttaatacgtcaagatcaccataggtttttgtaagatgatccacagtgatggctttcatagttatccctcattcctgattgaaaagtgtctcgtgcttgattttatctagctgatctacaagaaacgtccatttactccagaaatcttggaggtaaatttccccatttgcgttcaaacgataaaacttccttgccggtccaaggtcagatttccttttttcaacagttaccaattcttttttttctaaacggagtaagaccgtatagacggtgccttcgacgatatcttgaaaccctaattcgatcagtgtattcgtgatttcatagccataagtctctttgctgttatggatgacttgaagcacgacaccttctagcacaccttttagtaattcagtcattcctttcacatcgctcatcctctcaaaaaccatttgtctcaatacctagtattactcagcactgctacataataatacttagtagatggactgtcaactattaagtatcattaagcagagatgcaaaaaaaagtaacaccttgaaaaaagcttcccgcttagtggcgaatggtactcaggagactggatcctgttaaactgagctttattgtgggctgctctgcaacttcttcgttcgaatctaagtttgcagctaatcatcgaagacagtgattagctgctgctcgccgttgttatcactcttaagaacaagttcaacaagataggctctgatttgatgaattgtgttcagtaaagagaaataggacttcggtaccgatcatggtgtgaatcattgacatgaaatgttagacatcgattgagaagggagcaaaaaaaatcgagatttattgggctctgttatgaaactaaggattgtttcgttagggaatgccgctgatacataggcgcccaatgcacttgatttgactgagacagtaagcaagcctagactaaaagaggaaagctcacaattgctgctctttatgcccagtcggtggaaatgttctgccagatgttgagagaggctgtgtcctgctaaataacaaagaacattgaataaaaaatcgtctgattcagcatataagtgtatgaataaacattgatgtgatgaatcaggttatttttattaacaaattcttgaatctagaataaaaaaacggtaaaaataattttaatcgataaaaaatgttatttaattaacgtacaattttttaggttgttagatcagtgatttcctagtatctagtaaaaaactctcattttcgactcagcatatcgccattttacaaaacataatctaagcaaaataaccttgtaaaggaagccaaacgggaataaactggcatttgtgaattttcagaaaaatttctaaatttgttttttataaggagccagtaagtatggaaaaagaaaagactttcctaggacagccgcgagggttgtcgacactatttttcactgagatgtgggaacgattcagctactatggcatgcgggccatcttagtttactttatgtatgatgctgtaacaaatggtggcttaggcctgcctaaatcaacggctgtagcgatcatgtcaatctacggttcactcgtttatatgtctagtatcgttggcggatggatctctgaccgcttattaggatcgaacaaatccgttttttatggcgggatccttattatgtttggacatattgttctggcagcgcctcttggtattgctgcactatttgtttctatgatgttgatcgttattggaacaggtttgttgaagtccaatgtgtcagggatggtcggccacttatattcgaaagaagatgtgcgccgagatgcaggattttcaatcttttatatggggatcaatattggtggacttttagcaccgatcattgtgggtattttaggacaaaacgtcaattaccatttaggtttttcaatagcagctatcggaatgttcattggtttggtgcaatattatgttcaagggaagacaacgttgaaagatgttgcaacgacaccaactaatccattatctgcgcaagagaaaaaaatctttttccgtaacgttatcatcgtactagtgcttgtagcagtggttttcggcggtgcagctgcgatgggctatctgaccgttgatttctttatcaattgcatcagtatcttaggaatatttttgccgatctactactttactaaaatgttgcgttctcgtgatgtgacaccggatgaaaagaaaaaagttttagcgtatattcctttgttcttatctgcaatcgttttttggtccctagaagaacaagggtcatcaatattggcactttttgcggccgatcggacacaagatacgttgtttgggatcacgattccggcgagtctttatcaaacactaaatccattgtttgtcgtgctgttgacaccggtatttgtttggttgtggacgaaacttggcaataaacaacctagaacggaagtgaaatttgcaattggtttgattttagcaggtttgtcttttgtcttgttgatgttcccaagtatgctgttcggagtcaatcaacgggtaagcccattgtggctagtctttagtttctttatcatgattgctggcgaaatgtgtctgtcaccagttggattgtctgtaacgaccaaattagcaccaaaagccttcgaagcgcaaactcttgctatttggctattagcagatgcttcttcgcaagcgatcaatgctcaaattgctcgtttctatacaccgcaaacagaaggggcttattatggcattgtcggtggtgttgcagtagtcgtagggattattctttacatggcaagaaaaccgattcgtaagctgattgggaatattcactaatcaacggacttgatcttgaaaaagatcaagtctttttttgcacttttagtcaatttatgagaaaataaatgggaacatatgttccgtaggaggggttaaatgcacacgcgacgctataaaacgattctttcaccaaacaatacaatgaatctctatcgagggtgtacacatgactgtatttattgtgatagtcgcagcagctgctatcagatggcgcatcggtttgaagatatcgagatcaaagaagcagcaataacgattttggaccagcaattaaagaagcgccgacagccttgcatgatcgttaccggtgctatgtcagatccttacgttcatgcagaacagcgtttgagacaaacgaggcaagcactggaagtaatcaaaaagaacggttttggtgtcgcgcttttgaccaaatcaacgcgtgtgttggaagatttggatttgctgatagaaatcaaccagcaaacgaaagcagttgttcaaatgactctgacgacttatgatgaagcactatgtaaaaaattagaacgacaagtcgctaccacttatcatcgttttttggcgcttaagaggtttcaagcagcagggattcctactgttgtttggttatcacctattcttccttttatcaatgacagcgaggagaatctgttgtgggttttggactactgtcgccaagcgggagtgaaaagcatcatctgttttggatttggggtgacgatgcgggaagaaaatcgcgcatacttttatcagcaactagaccgtgattttcctggtatgaaggaaaagtatcagcaagcttttggcgatcggtatgtttgcgacagtccgaatcagcaaaagctaatggctattttttgtgcattctgccaaacctatcaaatcctttatcgaccagaagaagtctttgcctatatccatcgttttgaagaccagcagttgacactcttttaattcgcgtcttttaaacaaatgaaatagccgcaaggactgagagtgttccagtgtacgagcaacacctcgtcaccctgtcacgaggtgtgccagttctcttatcctgcggctatttttatttgatttttctgatatgcgattccttatggtgaaaaaaacgaacgtggtcttcttaaagagcctgccagtcgatgggctgccgcatgacctgctggtcgcggatcaacagcatgtcttggaaagtttgttttagaaaatagcggtcatggctcacagcaattaacgtaccaccaaagcgctgaatcaattcttcaatttcttcacgagcatagatatccaaatgattggtaggctcatctaatagcaggacgttgatttttttatgaaaaagtttcagcagataaaggcgaatcttctcaccgccagaaagatcctgaatgcgttttgagacatcatcctgataaaaaccgatttgtgccagttgttgtcgtgcagattgttcattgcctatgaactgataggcaaaggataggacccgcatagcgggattagaaaatgagagcttttgaggcagatacccgatctgcagattactgccggatttgatcgttcccgcgtcaagcgccaaagtacctaacaaaagctgaatcaaggtcgtcttaccggtgccattttcaccaatgatcgctaagcgctcaccacggtaaatcgagaaactactgtcttcaaagagtagccgatcagccatgactttaccgatatttcgggcgataaagacttctctgcctgttcgatcactttgattgactgtgcgtatcctttttttaggaggcagcgggggcttaacgagagtgatcttcgctaaacgcttttcaatttctttggctttacggaaaaagtcctcattgtccccttcattcccccattggcgataacggcgaatcatcgctttaagccgctggcattctttttgctgcagctcatagttcttagtcagttctgcgattcgagcttgtttcaatgaacgatattggctatagtttcccggataagaaatcaattgaccatcttcgatctcacagatcctagtcgtcactttgtccagaaaagcgcggtcatgagagatgacgatatacgcttttttcgtattgataagatagttttccagccaatgaagactagctaaatcaagatgattcgtgggctcatccagtaaaagcaagtcatgctctgtcaacagcaatcttgctagttctactttgactcgctccccaccacttaacgcctgcaaagaagtttcttgcaactgcgctattcccaatcctcttaaactagcaagaatccggtcttctaacagatagccaccgagttcttcaaattgtagctgtaattgtccatagcggtccaataatttcgataagtcagcgtcaggatcgctcatctgttgttcacaacgtcgcatcttgcgacttatctcttgcagtcggggggaagaggtttgtaaatacgtcagcaccgtttctgaagagggcgaaaattcttgtgccaaatgaccaatagaaagacttttacgtcggctgatcgttccagtatcatttttctcggtcccgagtaataaatctaataatgttgtcttaccagagccattgatgccgattaaaccaatcttttcaccgggatcaatttggaaagttaattgttcaaatagcggggtaccgccaaaatttttactgattttatttgcttgaattagcatgatctcactccttgagaccactcaaaaaggccatggaaatccatggcctgcgttatttttatctgatgttgttcgagataaacaccttgagatggccattgattttacgaatattcaactgttttagacagactcgtccctaaaacggtttttgtaaaaccaattgcatggctaaatgcgatatggtaacgctgataattgacgttacatgttattttagtcatgcgcatcatggtgtttcctccttttgcttatttgccaatagtgtaccgcaagtgaccttactttgcaattagtcagttagttttttcttgactggaacaatttcagaaaggttacttgccttcggttgcccaatcactaatggaacggtctcatggaccacgtcactgtaagtgagtccaaaccaacgttccggagaaatagtatgccgtttgataaagagtttggttaacattacttgccgctcccatcgggttaatgaggtgacattcgacaactcttcttcgatcagaacaaactggaagtcgccaacttgacgtcccggggtcaatgagtatttttgcggctgttttggtaagcgaccatccttcatcaattcttgaatgatttgtcggatgtagacattgacttcttgagaaacccgaaaacctaagtagagtttcaattttacgatgaaatctgtctcagccatcgagacttcgtactgttttgtataaggttcatctgtgacttccacattcacaaaccaataaactttggcgcgtttcggccgtttatcaaggatcgaataaataaactgacggccaatcgtatttccttgcagtttaggaactaaaaagacgacattggtctgagaaaatggcaatgtctcatcattccgcaattcctgtagttggggaatgtattcggtcaagtcaacttcttcggcagcttgttcttgaatgtggttgccccattcccaaatgagcatgatggcgataatcaaagcggccatcaaaaccgcaacgaacccaccgtggaaaaattttgcggcactcgagatgaagaagatgccttcgatagctgcaaaaaataaggtaataaatggagcgataaatcgcgcttttttgaattgacgcaaaaagaaatataacaagactgtggtcatcagcatagttactgtaatcgctaaaccataagcggcctccattcgcgtggatgtccggaataagagaacgacaccggaacaagcgatccacagcatcaggttaagcgcggggatatacatttgtccgatggaagaaccaggatacatgatctgcatccgcggcaacaaacgcaacttgattgcttccgaaactaacgtgaaagatccggaaagtaaagcttgggaggcaatgattgcagccaacgcagaaaagccgacgccaaaaacggtccaaccttgaggcaaagcctggaaaaaagggtttaggttttcaatctgttgataggcaggatcttgataaacctttaataaccaagcagcttgacctaagtaattaagcatcaaacagattttgatgtaaggccagctggcataaatattctttttgcccacatgtcctaaatcggaatatagtgcttcagcaccagtggttgccagaaagatattcccgagaatgaacagacctgaggtgttatcagggctaaacagcagcccgatggcataacgaggatccaacgcacgaatgacagacagatcaccggaaaagttgatcaaaccgacgatccccaaaaaagtaaaccaaccaagcatgatcggtccaaatgctttcccaacgaattctgtcccaaagcgttgcaggctaaaaagaacgaaaaggatcgttaatgtaatccaaacaataatggattgatcattcccaaaatgatcataaaacatcggaatgccccgcaacccttcaatggctgtcgtgacagtgacggcaggagttagtacaccatctgccaataacgcagcgccaccaatgattgccggaatgatcaagtagcggctttgcttacgaacaagtgtgtataaggaaaaaattccgccctcaccgtgattatccgcgttcaaagcgattaagacgtacttaatcgtggtaagcagagtcagagtccaaaaaacgagggagacacttcccaatacaaagtccggggagagtgttttcaacccgccgttgtcttcaacgattgctttcatcacatagagtgggctggtcccgatatctccatagaccacacccatggcgaccaaaaggcctcccgcggttaattttttcattttactcatagattttccctccaaattgaactgcaaaaaagacccaagaggccctttgccacttaggtcttgcaagaaacatcatagaccagcggattcccgcttgctgttgatctatgatcatggaaaaacccatgtgctactcccctaaattgctataattatctttgttttgctgattcctgtcaacttttttcatttaaaatgtaaataaacattttaaattttatgtttattcacgtaaaattacgttaagtcttatttctaagggggatagtaaatgattgaattgaaacatgtaagtaaaacgtacggaacaaaaaaagcattgaaggacctttctttgacgattcagcaaggtgagatctttggttttttaggacataatggtgcgggaaaatcaacgaccatcaagagtctagttagtattttacagccgacgagtggcgaaatcgtttttgatggcaaagcattagcccaataccgagaagaaataaaaaaacagattgcttatgtcccggattcaccggacatgtttttgcagttgaccgccggagaatattgggatttgatcgcagctgcttatgaagtaccggaaacccaaaaaaaggtacgcttaaatgaactgggacagttatttgatatgacgacgcatgcagaagaaacgctagccagtttttcccatggtatgcggcaaaaaaccattctaattggagcattactgccggatccggatatttggatcttagatgagcctttgcagggattagacccgcaggcagcgtttgatctaaaagaaatgatgaaagcacatgctgcgaaaggcaaaacggttattttctcgacgcatgtcttggatactgcccaacagctttgtgatcagttagctattttgaaaaaaggcgaattgctttataacggttctgtcgatgaattgcttgcacaaaatccagatctttctttggaagcgatctatttaaaaatgacaggtagaggcgcggaagagccatcgttgacagaaaatggaggcgagttcagatgaacaagcgacagttattgacgttgacaagcgtcaatcttcggtacgccaatccgcaagtcacagataaagcccgtaaaaaaggaaaaagcgggacacaattgactcgttatttgatccaacaatatgtattatcaggtttcgtttttttagtgatttacggtctaacaatgatcgcactggatttcagccgtttgccaggttttttcacttattatgttgctctttttggcgttctaggattttctcaaggaatctcgtccatttttaatgtcttctttgagagtcaagacttgcctgcatatttgccattgcctttccggcaagcagaaattttcaccgccaagattcttgttgtctttttaacagtggcaccatttgtttttccgttatttgtcttatttcttttaacaggaatgcgttcacaggtctttattctgctcacgcttttgttagcgattgtgctctttttattatttctcgtgattgtttttagtatttgtagtttgatcgtttttggattagctcgaacaaaattgtttcgtgaacataaaaaaatgatgaccagcttgttgttgggaatttctatgatcgtagtagtggtagggatcttgatgatgaatcaaaccagttcctacgatacacagatcatggatcgcggggccattgcctttttactgccatttttctatatcatgcacagtccctttgcagttgcaggaatcgggagctttgctattgttctagtggtttgtttgttgctgctaggagcgattcggttctttattttaccgaagttttatgatcagatggcgatggctgtgcccgaccatggaagcgtgcgacggaagcagaaatccgggcaaggattgtcgcagatgttattcagttataattcccagctggttcgtgatcccaacttgattatgcaagtattgtccacttcactgatgacaccgatcatttttattgtgacatttgcattgagcggtacgtttgatctaggacaaatggatgctcgtttttgtggagtgttctttttggcaggtatcgcattagctgtgatgatggtcaatccaacctcttttatcagtaccttgatttcattggatcagcaaaattttctgtttgttcgttcattgccgttgtctatgaaaaaatatttacaagcaaaattccgatttggcctaatgcttcaaatggttttgactggcgggattgccttattggcgattttgctctttaagatgccgatcctattggcaacgactttctttctaggtacgttacttggttgttacttgctatgcttaaaatattttgcccgtgattatcgcttgcttttgcttgattggaccaatgtcagtcaattgtttacccggggtgccggaagtgtgggaatgatcgtcggtatgatggtggcacttctccttagtattctgttactcgtcggttacggttttgcagcaacgatgattccattttggctcttgaatggtccagtcttgctagttctgttaattggtagcgtgctatggcacaactactatcaaagaaaattttggcagttgattcactgagtctagtcgtcatcaatagcgcatagaaaaagaaatagatttaatcagaaaattcagaaaaaagactttacaagtattcagaaacatgattagataataaataacctattactttgctttcattttttgctggcaagcttgctccacaggcttgttgcaagagactgtgccaaacgtcatactgattagaaggaaccagaagttgtccgcttcaagaaagacagctgggtcattttgagctgagacggatggcgcagtttttttaatggctaaaactaacaaatcgtgaaaaatagaaaaaaacactctgacaagaacctttttgtcagagtgtttttgtttttgatttgagtatgtgttggttcattcagagattatgcttcctctttttcgttggttgttggcagatgattgtcaaggtctgtccgtacgaccaatacgtcacaagaggcatgacggattacatactcagagactgaaccaataaaaattcgttcgacggcattgagaccagtagcgccgatcatgattaaatcgatttgattatcttctggtaattgtttcgcaatgattggttttggcgaaccgtattcgatgacagtctttactgcagttacttggttcttacgggcatagtcttcataatctttcaatgtttgcttagccatttcagtcgcttgctcagccaacatgccatcaaaggaagaaacagtttgaaaggcacgggtatcgattacatgggctagtaccagttcagaattgttccgttgggccacattgaccgcttttttaaaagctaattctgactcacttgagccatcgactgcaaccatgattcgttgatattgttgtaacatatgaaacactcctctcagataacttcatctttattgtaaaactttttgactaaaaagaaaaacctaattatctgtttttttcatcttacgggcaaacagcaaactgaatgaggcagaagtaatcattaacactgctaaataaacgagggcaatcaattttttgtctaaaaaagccacgatgattgcaagaatacctaaaacaccatgaagatagccataaatggtcaaaaaagtttgatttttagtattttcaggaataagggaaaagaaaatggcatgttttgttaacagtaagtagcagacgccaaacaacaaaacagcagcaatcaaaaataatagaaaaatcatccgtgaaatccgtccttctcttataagatagttttagtatagcgaagtgctaaaggaatagcaaaaagcacaaaaaagccatctgtctaaaacagatggcacattcaataaagaatgggtaatatccgtagatgccgttctttttcccgtagtattgatcccgcaaattctagcaggtgggttccacggtctaagcatcgaactaccaaatgaaaaggcatgttaccagctttgacacaagacggatcccaatatatcaataaaaatgttcggtcaacacacagatgggacaactcgtacatcacagaattcccaccttcatagtagcataggacaacaaaagtagcaataaagaagattgaaaacggtgacagaaacctttttcgcttccatgaagcggctgccgagggttaggtctgtttttttcgttgctgcaattgttgatatctttgacctagagcttgctcgtattttccggtagcctttggctgataatagtgagcttgcttgattttatcgggtaagtattgctgatcgacccacgcatcatcaaagttgtgcgggtattgataaccgacgcctcggttcaaggcttcagctcttttgtaatgactgtctcttagatgatcagggacatccccggcattgcctgcacgaatatctgcgatggcagcgtctagtgccatataagccgagttggacttaggggatagacaaaggtcgaccacagtatctgctaaagggatcctcgcctcaggtaagcctaatcgttccgctgctaagacagcattgactgttcgagcagctgccgctggattggccaacccgatatcttcataaccgatcaccatcaaacgccggcagatgattgccaagtctcctgcttctaccagacgacccagataatggagtgccgcatcaacatcactgccgcggatcgatttttgaaaagcagagatgacatcataatgggcatcgccatctttgtcatgggtcaatgctttgcgctgaacacactcttcaataattggcaaagtcaaatggattttcccatcagaacttggcggcgtggagcgagcagcgagttctaatccattgagtgcactgcggagatccccattggtcgctcgtgaaagatggagacgagcttcttctgtcaactggatcgattctgttcccaagccacgttctttatcagctaaagccgcatcaatggcggctaaaatatctgattcttgcaatggttttacttcaaaaatctgtgtacgactacggatggctgggttgatagtgatataaggattttcagttgtggccccgatcataatgatttttccgctttctaaatgaggcagtaagaaatcttgctttgttttatccagacgatggacttcatccaaaagtaaaatgactgtgccgctcattttggcttcttcggcgacgatttgaaggtcttttttcgtatcagtcgcagcattcagcatgcggaatgcgtaacgtgtcgaaccggcgattgcactagcgatacttgtttttccggtccctggtggaccatacaggatcatggaagagagcatcttggtctcaaccatccggcgaatgatctttccgggtccaactaaatgctgttgacctacgacttcatcaaggttgcggggacgcatgcggtacgcaagtggttgctgcataataagctcctttcttttttctttagtatatcataagaacgtatattcccataaggaagcgggtattttgctattgaaactagtcagtggcgatagaaaggtcaaacaattgataagatggtcgtaatcaatagtaagttccttgagaattgtgtaaaataaagaaggtgaagaaaatgaatgaaattgaacaattatttgcacaacaatcaacaacagcgattgcccggcaattattagggatgtatctggaacatgagacgcccagtgggaaattaggcggttatatcgtcgactgtgaagcttatttaggaccagaagatctggctgctcatagtttcgggatgcgtaacacgccacgagttcgagcaatgtatgaaaagccgggaacgatttatttatatacgatgcatactcatttgattttgaattttatcacacagcctgaaggcattccccaagggatcatgatccgcggcgtggagcccgtcgaaggaatcgcacaaatggagataaatcgcagtaaatccggtcctgatctctcgaacggacctggaaagctcgtgaaagctttgggaattacgcctgattattatggccattcaatttttacaagtccactgcatcttgtcaacgagaaacggcgaacaccgaaagaaatactcgctgttcccagaatcggtatcccgaataaaggggagtggacccataagccgctgcggtttgtcgtagcaggtaatccatatattaccaacagcagaaaatctgctgtccagccagatcacggctggcaataggaaagaaggaacgtataatggctaaagaaacaatgctgacttatttggacagacaattaacaaaaaaaatccctgagtacgatgttgcccttgattgggatgcaagaaaccataccatcgaacttgttttacgcttatttgcagagaacccgaatcatttgcaggtagatgatgcccaaggagtagcctctgaagaagagatcatcgaatttgaagacggtattttattgtttgatccccaaaagtcttcctttgcagaagaggactttttggcagtcattccctacgcaggcaaaaaaggaatccaaaaagcgttgctggatgctttggttgattacatcaaagagattctgacggagggagaaagtgatttactagattttctaaacgatgagagtgaagaagcggtcttcgaactagttttcgatcaagatcagttgttagaccgtatgaatacttaccaagaaagcgatggggaatcgtatattccttatccaagttattaaggagcagatagatgaaatggaatgaagtgaaagtagctactgcaagtgaagcagttgaagcggtcgccaacattttgatggaacaaggggccagtggtgtagcaatcgaagatgttcttgacattgaaaactttaaaagcgatgcctatggtgaagtgttagacaaagaaacctatacaacgctggatgaaggcgcccaggtaacggcttatttccccgagactatctttttacctgaaattttgccatttattgaggcggcgatcgctcgtttaccggaatatgggttagcaattggcaaaaatgagattacctccagcgaagtagtagaggaagagtgggcgactgcttggaagaaatattatcatccagtacggatcactcgttatttgacgattgtacccagctgggaacaatatgaaacgacggaccctgccgagaaaatcattacgctagatccaggaatggctttcggaactggtacccatccgacgacgcgcttgacgttacaggcgttagaaatgtatttacgaggcgaggaaacggtcctggatgttggaaccggatcaggggttttaagtattgccagccgccacttaggggccaatcaagtatatgcctatgaccttgacgaggtggctgttcgggcggcaaaagaaaatatggcactaaacccagttgccgaagcagtgaatgttgctgccaatgaccttttaacaggtattgaaatcgaagcagacattattgtagcgaatattttagctgatatcatcttactgatgatcccagatgcttggcggttgctgaagcctaccggaacattaattgtttctggaatcatcgaagcgaaaaaacaacttgtgatcgatgccatgacagagcaaggatttgttgttgaccaaatcttgaatcaaaaagattggtatgcgatcgcactaaaaaaaccagagtagggaatgtcatatgcagcgatattttttgaatgaggattatgaggcgaagcctgtttatgtagtagagggagaaccgtttcatcacatggtacgtgtgatgcggatggttccggatgattgtgtctacttggtctttcaagaccaagtagcgatcctcgcgaaaatccagcagatcgatgaacaagcggttcatttgattgaagtagaaaaggaacagcaagacaaagaattaccgattcatgttacgatcgccagcgggtatcctaaaggagataaattggaattgatcgtccaaaaagggacagaattgggtgccgctaaatttatcggttttcccgcccaatcctcggtagttaagtgggaccataagaaactccaaaagaaacagcagcggctgcaaaaaattgcccaagaggctgctgaacaagcgcagcggcaacgagtaccgatcatccaactggctgcttcggacaaagagttgtgggatagtctttcaaactatgactatgtgatcgttgcttatgaggaatctgctaaaagcggcgagaatgccaaactgatcgatattttgtccaaagcagcgcccggcagcaaaatcttagcaattttcggacccgaaggtgggctgacacctgctgaaatcactcgtgctgaatctcaaggtgctgtgatctgtgggttagggccacgtattttgcgaaccgaaaccgccccattttattttttgagtgctgtcagcgtactaactgaattagtaaggaagtgatcaagtgacgcaattcaaagacaagcttagttttcgatttttacaagctggactgacggattggttgttaaaagatacgtttactgaatttaacacacttggtgtccaagaagtcatcgtgttgcctagtgatttgcgcagagcgaagcagttaactgaaggctccgagatccaagtcggctgtgcagttgattttcccttggcacaaggaacaatcgctaagaaagcttttgagatcggtcattcctttatggatggcgctgattttttagaagtctggctaccagcggctttgttggtggaaaaagagcggacggctgatctggcggagttaatggagacaagccggtcactggctttgtctggtggtgagatccgctgggctgtcaatacttcacttatgaatgagttgacaaagatccaagtagcacagcgtttgaaagcatgggactggcctagtattactcttggtcagcagttaactgtttcagatgcgttgcatgatgtctcgatttttgctttagatggaggaccgcaactgacgatccaagtcaacacggcagcgtctgttacggatcagaaatcacttgcagaacttttacaggcaggggcggcaaaaatcggcgtgccctttacagagtcagcgttactgttgaatgaataaaccggtattttgtctcgcttgaccagaatagagagaattgaaaaaaacaagaaaaatttgtataatgacactaatcataaaagaagatggccaggcagaagcgcattgcttcaagagttctgctattcagagagttggggatagcagaattctttagaagcggcttctgtcttgctttttgaaaataggaaaaaaggaggcgcgtttcatggcaaaagaagtgatattatccggacctggtgtgatcaagctcgtggcccattatatgagtgaagaacatgttgcatttgtacagaaagctttagattatgcgacagaagcccacaaagatcagtttcgcaagtccggcgagccttacatcatccatcctattcaagtagcagggattttagcggaactacaaatggatcctcatacagtcgccactggttttttacatgatgtggtagaagatacggaagtgaccctagcagatctaaaagaagtctttggtgcagatgtagcgatgctggtcgatggtgtgacaaaattagggaaaatcaaatacaaatcccatgaagaacagctagcagagaatcatcgcaaaatgctgatcgcgatggctcaagatttgcgcgtgatcatggtcaaattagcggaccgcttacataatatgcgtacattgaaacacctgcgggaagacaaacaacggcgaatcgcccaagaaacgatggagatttatgcaccattggcgcatcgtttagggatcagccgtatcaagtgggagctagaagatatttcactacgttatttgaatccacaacaatattatcggatcgttcacttgatgcaaaccaagcgggaagaacgggaagcttatgtgtcggaaaccgttgaacagattcgacttgcaactgaagaactagatatttttgctgagatctatggtcgtccgaaacatatctactccatttaccgcaaaatgaaagaccagaagaaacaattcaatgaaatctatgatcttttggctattcgggtaatcgttgattcaatcaaagattgttatgctgttttaggaacgatccacacaaaatggaaaccaatgccaggtcgatttaaagattacattgcgatgcctaaagcgaatatgtatcagtcactacatacgacagtgatcggtcccaaaggcaatccagtagaaatccagattcgtacccatgagatgcatgagattgctgaattcggggttgctgctcactgggcatataaagagggtagaaccgagaaagtcaaagcagacaaaatgacccagcaagtcggttggttccgcgaaattttggaactccaggatgaaagctacgatgcttctgaatttatggaaggtgtcaaaggggacattttcagtgacaaagtatatgtattcacaccgaaaggcgatgtcacagaattgcctcaaggttcaagtccgctggattttgcctacagtattcataccgatatcgggaacaaaaccactggtgcaaaagtgaatggcaagatggtccagttggattacaaattgaaaaatggcgatatcattgaaattttgacatcaccaaattcattcggaccaagccgcgactggatcaagcttgtagctaccagcaaagctaaaaacaagatcaaacgttttttcaaggcccaagatcgtgacgaaaacatcatcaaagggcacgaagcagtggtcaaaacattgcaagacatgggctttgtaccaaaagaatttttaacgaaaagcaagatggcagaagcctgcgaacgatttaattatcaaacagaagatgatttatttgcttctgtcggttttggcgaagtgagtccaactacactggccaatcgtttgacggaagaagaacgccgtgagaagcagatcgaaaaacaaaaacaacaagtacaagacatgatcaatcagccagcgaagaaagaaccagagaaaatgaaagtccgccatgaaggcgggatcgtgatcgaaggcgtggacaacttactgatccgaatctctcgttgctgtaatccagttcctggtgatgccattgtcgggtatatcacgaagggccgcggcatctcgatccatcgcagtgactgtccgaatgtccaaagcaaagagatcgtcaatcgtctaatcgatgtcgagtgggaagatacttctaacagcggcaaagaatacgatgcagatctggaaatctatggttatgatcgttccggattgttgaatgatgtcttgcaaacagtcaacgctgttactaaacgattggtcagtgtggaagcgaaaaccaacaaagacaagatggccaccattagaatcacggtctcaattcagaacctaacacatcttaagtcaattgtggacaaaatcaaacaaatcccagaagtatatagtgtcagaagaacaaaggggtgagacgcgagacatgcgagcagtcattcaacgtgtaagtgaagccagtgttgcaatcgatggaactactgtaggagcaatccaaaaaggttttttagttctcttgggaatcactcatgaagatagccaagaagatgtggattacttggttcgaaaaatcaaaaatttgcgggtgtttgaagatgaagcgggaaaaatgaatcaatcgattgaagcaatcgaaggtgctattttgagtatctcgcaattcacattgtatggcgagaccaaaaaaggaaaccgtccaagctttattcaagctgccagacctgaagtggctacaccattgtacgaagctttcaatgcgggtctgcacgctgcaggtatcgaagtggctacgggtcgctttggcgcagacatgcaagtgtcattaatcaatgacggtcctgtaacgatcctgatcgatacgaaggaaaaataggctgcgttcacaacgactgcctatccaacatgccaaaagaaccaaagcaaatagtttaaagaggactgccaacatgcaagttggtagtctttttttagtggaaataagtccatcttgtagcacttctggtaccaacccttttgtctttggactatcttacaaaactgtaagatagttctttctgatcagaaatagttatttaagagctgaatctattccttttcgtaatggtagcagttacaaaaaagttatttatttttatccatccctaaaaaactttcaataaattagattgtccttaaagcgcaaatgtgaaataatagttaaaaaataatgtcactggaggaaatgacaatgaatttttggcagcgtgcattaaaaagtgttactcgcaggaaagggaagtcgtttattttatttttagtcatctttattttaggtaacgtgatcgcaggtgcggtagctgtgcagcagtctactatgaatgtggaacgggaaacgaaaaagaaaatgggcaacgttgctacagtcgagtttgattatgagcagtttgagaaagacaattcaggaaaatcagatgaggaagtttattctgaagaaaatagtccgaaaacgccaaaaacggcggactatgacaaagtgggagaattagattacgtcaaatattacgactataccatgatgggttggttagagaccaagaaattcaaagcctatacaccagaagatgaatcttttggcatggcgggcggcaattattttaatttaaagggcggcaatcgaccacagccattagatatggaagaaggcaacatcaagctgatcgatggagaagtgtttagtgaaaaagacttgtcagaaaccactaactcgattttgattagtaaagaagtcgctgaaaaaaataatttgtcggttggcgatcaatttgtttgggatatgtatagtgaagtccctcaagatccgatgggtgacagtgatgatagtacggctacttcagatgatgaagatgcagagagtgaaagtgcagaaatccaaacaaaagttgtcacagctgattatcctgtcaaaattgcagggatttttagtgtagttaaaaaggaatcggccaatagtaatccttcgcaagaagaaaaatccaatcaaatctggcaagctgttgaacagatcaatacgatttatgctgccaatcagttggtgaaagattttagtaaattccaaaacgaaaaattgtggggagatacggtaatggccgaagatacggaggccgaaccggaagagtattatcaagcgatgtatgttttgaactctaccgacgatgttgaagcattcaaacaagaagccaatccattattaccagattactatcatgtggtagcttccacagatcaatacgatcagattgccggaggaatgaatcgtctgggaacgatttcccgctatatcgtgattgttgctgctattgctacggtctttatcatttcattagtcgttctattgtttttgcgagaccgcaagcaggaattagggatctatctatctttaggagaaggccgtgggaaagtgattgggcaaatcgttattgaagtggtgctcgtcagcttagtcgctctaatctgctcattggtgacgggaaatctattaggaagtgcggtttctcaaacattgatgcaaagtgactggatgacgaatctgtcccaaacggatacctattccatttcaagcacaatgatgacaaatactctcagctatgcggatgtccaaagtgcttataaagtcactttttctatggggtatgtcatcacctatcttttattgggattaggtacagtcttattgtctgcaatcttgccgttgttgtatattctacggctgaatccaaagaaaatcatgatgtagggggaagaaaaaatggctttgttggaaacaaaagaagtagattactattatcaagatggcgatcagcggcgctatattttgaaagaaacatcggtggcgtttgaaaaaggcaagttttatgccatttcaggacagtcagggtcaggaaaaaccacatttctctctttgatcagtgcgttggatacacctaaaagtggcgctgttttctttaatggagaagatattcaaaaaatcggacatgagaaatatcgccgagacgatatcagtatcatctttcaaagttacaatttgattccttacctgtctgcggtagaaaatgttctagtcccaatgtcgatcacggataatcaattgccggagaaccagcgggaagtcgcatacaatttattggactatattgggatcacgaaagaaaaagcagatcgtttagtcaatcagttgtctggtggggaacagcaacgggtggcaatagctcgtgcactggcgacgaatgttgatattattttggcagacgaaccaacgggtaatttagatgaagaaatggaacaggaaatcatcgatatttttaaagatttggctcatatgcataacaaatgtgtgattgttgtgacccatgcgaatgaaatcgcccaacaagcagacgaagtactctatttgcgtaaaggtgtgttgaataaagatgagtgattttttatcaaatttcagtcctggtaattacgatggcaagaaacaaagctctcctaaagaaactgagtttgacgaaaaaacagagcgtaaagcagaaccaattccagattctcagacatctgatcagggcgcaggagagagtaaagctgcagcagcatcggatccgaaggaaatgaagcgaagaacgcgcaaggaaactagctcttctcaaccggtcagtcggttcggaaaagaagagacagagtttgatccaacttatcgcaagcggcagcgtaaaaaatacgcgctgatcgctggtgctgtcattgtgctgattgccatcagcagtgtggtgtattatcaattgactcatgtgaaggttcctgattttgctaagaaagatttatccgaagcccgaacatggggcatggaagaaggcgtggcgatcaaagtcgatcaagtgtatgattttgaggtagagaccaatcgaatcgttagtcaaagtgttgctgcagatcagaagatcaaaaaaggcaagactttgacagtcaaagcaagcctaggtcctgacccagaagaaatgatcgagctgcccgacttttcgtcactgactaccgaagcggcaaaagaatggatcgagaaacaaaaggcagaaaatatctcgttgatcgaacagtatgacgacaaagtcgaagcaggtgtattcatcaaacaagaagcagcaaataaagagcaagatctcaaagcttataagcgcaaagatcgcttaagcatctattattcaaaaggaaaagaagtcttcgagaagaacatcgaagttactgattttacagggaaaaacaaaggtgaagctcaagagtgggctaagaaaaatgaattgaagtacaaagaagaagctgttttttctgatacagttgctctagacgtcgtggtttcccaagaaccagtcaaaggcagcaaattggccaaaaaggatcaatttcttgtcaaagtttctaaagggaaagcattagttgttcctgatttctcacagtataccatcgagcaggcagaggggctagaatcgaagataccgattcaagtcaagacagtttattctgatcaaatcggttatggcaatttcatcagtcagtcggaagaggcgggcaaagaatatagtgacagcgatacattgccaacagtgaaagtggtttattcactggggcaaccgtatttgaaggatatccggcaccaagcaacggaaggcgatctgccaaaaatgttctttgatgagtacaaatcgaaaggtgcttctgtatattatgatgtctactatgtagattcagcagaaccaaaaggaacagttgtggagatgagtcgttatggtgaatttattccattggaagtatcgatcaccatcgggattagtcgcggaaatctgcaaggcgagaccgaatcattaccggtcagtcctgagacagaaaatgtaaaggatccgctagaaacagtcaacagtgccactaccgaatgagacatttagcaatcgggcccgtaacaaagctacagaacccaagcaataagtgagtgaactatctaaatgaagtgtgtcttctgtttgtcgacaatgacagactgaaacagaaggatctacctgcatttagatagtttttctttttttttacttggattttgaaaaatggagagagtttttttgttatcaagtaatcacaggttttcaagcatgcatgcttgaaaaccttttatcgatacggtacagttgaattgataaccagtcaataagcagtattttacatagagaagggacgaaagaaatgatcaaaaaattactagcaaatgttggcgattataaaaaagccagcctattgacaccggtctatgttgccggcgaagtggcgctagatgtcattatgccactgatcatggcaatgatgatcgaccaaggaattgaaaaaggacacgcgggcgtcattttgcgctatggcggtctgctttttttgtgctcattattggcactgatgctaggaactttaggaggacgaacagctgcgattgcttctgccggttttgctcgaaatcttcgccacaatctttttagcaagattcaggatttttctttttccaatatcgaccgtttttcttcctctagtttgatcacgagaatgaccaccgatgtgactaatgtgcaaaatgcttaccaaatgattatccgaatcttggtgcgcagtccattgattctggttttctcactgatcatggttagcacgatcagtccagaattgatgctggtttacctagtcgtcttgccaattctagccatcggacttgctttagtgattcgctttgctcatccgcttttcttgaaagtatttcggatctatgaccgtttgaacaacgtagtccaagaaaatcttcaaggaatccgtgtggtcaagtcctacgtcagagaagagcagcaagaagaactttttgacgaggtgtcaaatgatgtctaccgcaactttacgctagcacaacgaatcgtctcgttcaatatgcctttgatgcaattctcgatctatagctgtatgttgctgttgtcttggttcggtgcccaactgatcgttgagcacagcagcttgacgacaggggaactggttagcatgttcaactatactatgcagatcttgatgagtttgatgatgatgtcaatggcatttgttcagattctgattgctcgtacttccgcacagcgggtggtggaagttttggatgaagaaagcgacttgaaaaatccggcatcgccattgacagaagtcaaagatggttcaattgtctttgaaaatgcttgtttcagttacgcaaatgatcaaacgagattggcattggaaaatgtcaacttacgaattgaatccggagaggtaatcgggatcatcggcggaaccggaagtgcaaaatcaacgctggtccaattgatcccccgtttgtacgatgtcattgacggtcgtgttctcgttgggggacaagatgttcgcgcctatgatttggcagcattgagggatcaagtcagtatggttttgcaaaacaatgtcctttttagcgggacgatcagtgagaatcttcgctggggaaacgcggaagcaacggatgaagagattcagcgggtagcaaaaattgcccaagcggatccttttatccaagaatttcctgataaatatgacacattgatctctcaaggaggaaataatgtctccggtggacaaaagcagcggttaacgatcgcgcgagcgctgttaaaaagaccgaaaattctgattctggatgactctactagcgctgttgatacaaagacagaccgtagtattcgagcaggattgaaacaagaaatcccgggaacgacaacgatcatcatttcccaaaggatcaattcgatcgaagatgccgatcgaatcattgtgatggatgatgggaaaatcaacggaatcggaacccatgaagaattattaactagcaatgaaatttatcgtgaagtctacgactcgcagcagaaaggatttggtgaaggtgaagaatagacaagcagcaaatccccagagaaccttgaaacggctgctggcgaccatgtttggcgattacaaactgcagttgattatcgtattgttcatgatcttgttaagtgcttttgccaatgttcgcggctcactttttttgcaagtggtgatcgatgaccatatcactccgctgctgggacaaagcaatcctaacttcagcggactgctggcagctattattcagatggcaattatttatttaattgggatcattgctggtttgacttacaactttatgatggtcaaaatcagtgagggcactcagaaaaaaatccgcgatcagatgttcaaacatatgcaaaaattaccgattggttattttgatggccattctgatggtgatatgatgagtcatttcaccaacgatacggatacattacggcaaatgatttctcaaagtattcccaatttgatgatggctgccgtcacattttgctcggttttcattgcgatgttttccattagtatcccattgacttgctttgtactggtttcggtcattttgatgctgaatgtgattcggatcatctcccgcaaaagcggccgcttctttggcgcacaacaacgggatctaggcgcagtcaatggctatattgaagaaatgatgcatggacagaaagttgtcaagatctttaaccatgaacacgttgtcatgcaggaatttgatgctttgaatgaccagttgcaatccagtgctacaaaggccaatgtcaatgccaatacattgatgccgatcatgatgaacttgctgaatgttcaatacgtgctgatcgcaattatcggcgggctctttgccatcaatggtgtctcgggactaaccgtagggatgattgcttctttcttacagcttagccgttcgctgaatggaccgatcagccaaatttcacagcagatcaactttgtgatcatggctttggcaggtgcagaacgtatttttcatttgttggatgagaccccagagattgatacagggtatgtcacgctagtcaatgccaaatgggaatctggccatttagtggaaacaacaaatcgtacaggactctgggcttggaaacatcctcacgaagatggaactgttacgtacacagaattgactggagatgttcgttttgaagcagttgattttgggtatgtggatcatcaaatggttctgcatgacatcaatctttttgctgaaccgggacagaaagttgcttttgtgggagcaacgggagccggtaagacgaccatcactaacttgatcaatcgtttttacaatattcaagagggaaagatccgttatgatggcatcaatattcaaaagatccaactagaatctctgcggcgctcattagggatcgtcttgcaagatacacatttattcacaggaacgattcgagaaaatattcgttttggtaaactggatgccacggatgaggaagtagaagcggcagcaaaactggcgaatgcggatatgttcatcaatcatttacctgagaagtacgataccgtaatcacgggggatggcgaagggctgtcgcaaggacagcgacagctactagcaattgccagagcggcgatcgccgatccgcctgttatgattttagatgaagcgacttccagcattgatacgcgaacagagcggatcgtccagtctggaatggaccggctgatgcaaggtcggacagttttcgtgatcgctcaccgtctttcgacgattcagaattcagatgtgatcatggtgatggatcatggtcgaatcattgaacgaggtactcatgatacgttattagcagagaaggggacctattaccaactgtatacaggaaaaattgagttagactgattttttcccaggaaacgaagaccggatttaagggtcttcgttttttttcttgctgctgtgctatactaaagaaaaactatgaggagtaagtggatagataggaggaaataggatgcatttaacggtttcacagatccaattgaatgaggaaatgtatgaactgggtgtcactgatcagggggctgcttattttggtcgtttagcagaacatgcagagttggctctttttttcccatatgcagaaattcgtgaatgttctcagacaccagaaaggtttgcaaagccgctgaaagcctatttcgccggggagccagtagccttcgattttccttttgactttgtcggtacaccgttccaacaaactgtttggcaagcgttaactgaagtcccttatggaacgactgtcagctatagtgaattagcggtgagaatccaacgtcctagtgccgtccgagcggttgccaatgctgtcggacgcaatccgatgatgattattgtcccttgccatcgtgtcctgggaaaaaatggtcgattgactggttatcggggaggtttgccgatcaagcggaaattattacagctggaagggattcctttcaaggactgagcgcattttttctgcaaaaatttactaggtcttcttctcgaatttagtgcttcataaattgtttgtttaaaagtaaaaaatactaaaaaggcgtttctttttatgctacctttgatataatggagttgtttccgtttacaaaaaaggagtggagaagatgaagcgaatgaagttgcaaaatggttcagatatccgtggaatcgcgctttcgacagcagatcttacagcggatttaacagaagatgcagtgaaagaaattgcttcaggtctgcggacctggttgctgcagcgatatacggaacccttaaaagtggcagttggtcgtgatagtcgtttaagtggtgaaacgctgcagcaggcgtttatgaaccaattgcgaatagaagggattacggttattgattgtgggctggctacaacacccgcgctatttatgagtacccagtttgctgattttgattgtgatgccggtgtgatgctgacagccagtcatttgccctattactttaatggaatcaagatttttagtaaatctggtggtgcagaaaaagaagatatctcgtttatcttagcacatcctgaagctcatccggctgaccaactcggcgagtattaccaacgagacttacttactccctatgcagcagatatggtgacgaaaattcgtcatgggatgcagacagaagaagaacagccattggctggaatgaaaatcattgtggatgctggaaatggcgcaggtggtttttttgcagagcaagttttagtgccgttaggggcagatacgaatggttcacagtttctggagccagatggacacttccctaaccacattcctaatccggataataaagaagcgatggctagtattatggaagccgttttacgagaacaagcagacttgggaatcatctttgacaccgatgtcgatcgatccgctgtggtgaccaaaagtggacagccgctgaaccgcaacaacatgattgctgttttaagtaaaatcgtcttatccgaacatccggctgcgagtattgtcacgaattccccgacctccactcatctaaagacatttattgaatcgctaggtggtcatcaagtgcgttatatttccgggtatcgcaatgtcatcaacaaagcgatcgcccttaacgaaaaaggcattaatgctcagttggcgattgaaactagtggacatgcagcattcaaggaaaactattttttagatgatggtgcatatgttattgcgaagatcttgatgttgctgccaacacttcgtgcgcaaaatatcagtttggaagacttgatcgcggcgctgaaacagccagttgaaacccaagaattgcgtttcaagatcaatgattcagattatcgcgcaaccggggagaaggttatcgcatcgctagcgcatcatctcccatcggggtggcagattgacaatgaaaatgaagaaggcatccgtatacaggtttctgcaccttatggacaagggtggtttttgttgcggttgagtttgcatgaaccattattggtcttgcagatcgaaaatgaccaacctggacatttgccggcgatcgtccgcgaaatcagtgaacgtttgctgccgtttgaagcgatcgaccagtctgcaatcaaacaatttttagaaaaataatgaatagagaatgaagggttaatgttggtatttattatgttagtgatcatggctgtcacttatggtgtgaatctttttctgatagcatacatgagaaaacgaccgcagatcgatgtggtagaacgattgtctatgttactgggcgtcaatatgagtgtcttgtttgtagatgggatcgttttatttgttggaaagttattattagaagcagcgatgattattgaatagacaaagaaactcttagagagtcagagaaaaggaacttttttatctggcggatttgagagtttttttagctttttttaaagctgggattatcattcgctttcgatttagatatttgttaaagtaaagaaaagaagtggaggggaatattcagatggcaaaaatcatggtagtagaagatgaagcagttattcgccagctgatcatcgaagaacttgaaaaatggcaattcgaaacatttggaacaactgattttcatcaggtttttgacgattttgaagagcaagaaccgcaattgattttgttggacatcaatttaccggtttttgacggctattattggtgccagaaaatcagagagacatcgaaagtaccgattatttttatatcaagccgtaatacgaatatggatatgatcatggcgatgaacatgggggcagatgatttcgtgacgaagccatttgagatcgatgtcttgattgcaaaaatcaatgcactgctgcgccgttcctataactatgtcgaaaacaacagcgaaacgctggttcacaatgggcttactttgaatatcgacaacagcagcatgcagatcaatgatgaagtaattgatttaagcaaaaatgagtatcgattgttatatatattgatgaagaatcacgggaagatccttagtcgagaaaagctgttgcgagcgctctgggatgatgaacgttttgttgacgacaatacattgactgtcaatatcaatcgcttgcgtcggaagattgagcaagccggtatggataattacatcgaaaccaaagttggacaagggtatattgtgccatgaacaaaccgatgtcattcattgccttcttaaaagaccgctggttacttctgattggttgggtgatttttttcttgctgatgattctagtgatgtggctgacacctgatttccccatcgactggggaactgttggctatctttttttgatggaatcagtcgttctactgctttttttgggcgttttttatattactaaacgtcgtttctggcaaaagctcacattccatgagtcagacagtgtcttacaaaactatattcatggtgcgcgttcatcagaggaagaactggttcaaaactatatcaatcatctgattcgcgaacaccaagacttgatgcagcaagtgataagcaatcaagaagagcaaaaggaatacattgattcttgggtccatgagattaaagtacctttggcagcgacgcgcttactgttaaattcgattgaatttgatattccagatgaaaagtatattttactggaaaacgaagtgaatcggatcaatgagtatgtggaacaagtgctgtatgtggcacgtttggacagtttttccaaagattaccttgttcaagaagtgtcattgaaagcgacgattcagccggttattcgcagtcaagccaacgtgttcattcagaagaatattcactatgcgattaaagggggagaccagcaagtattaactgacggcaaatggctgagttttatttttcggcaaatcctcagtaatgcattgaagtatactccggaaaatgggcgaatcattgtccaaatccaaaaagatgggcaaggaacgcgtctttcggtagaagattctggaatcggtattccggcagaagatctaaggcgagtctttgataagggatttactggtgagaatggtcggaagactgatatgcactcgacagggttagggctctatttagccaagaatctggccaaagaattaggaattgagttaacgatttcatcggttgtgggagaagggacaaccgtcacgctttacttccctctgctaagctactatcaagaaaatcgctaatgattttttgagaaataccatttagttcttgtctctataccgttttcactgatacactgaaccttgtgtgtcaaattgaatgataaggatggataagatgagtatagtatttgctttaataccgatgattgcctggggcagtatcggattggtcagtggaaaattaggtggggatgcgaatcaacagacattaggaatgacaattggtgcattccttttttcactgattgttttctttgtcactatgccgacgattgatggctggatcgtagtgattggtttgctgtcaggactttgctggtcagttggtcaaaatggtcaatttcatggaatgaaatatctgggcgtttcggtggggcttccgttatctactggtatgcaattgatcttaaatacaattgctggagcccttttttttggcgaatggacgcaatcacgagactatttgttgggaatcaccgcattgattttattagtaactggtgcctatttgaccgcacgacaagacggggaacaaatgcctgagacagaaaacaagatgttggattttcctagaggctttcgttcgttgatttcctcaacaattggctatggtgcttacacaatcattattacttgggcgggaattgacccattggcaataatcttgcctcagagtataggcatgctgattggcgctagtttctttgctctaagaaaaaccaaagtcaatcgggcggtctggaagaatacattatcaggattgttgtggggaataggaaatgtttgtatgttgataacagttcaacagatcggactggccgtgggtttctcgctgtcacagatggggattattatctctacactgggaggcatattcttattaggggagaaaaaaaccaaaaaagagttcaaatatgtggtttttggttgcttgcttgttatttttggtggtatccttctagggtatatgaaagctgcataagtagtgaaatttaggaggatttatggatttatttcgtaaaaaaactattgaagccagtcccgttagtcatttgaaaaaagatttgaaattgaaagacttgatcatgttgggtattggcgcaatcatcggcacaggtatttttgttgtgaccggcgcggcttctgctgtatatgcagggccagcattgatcttgtcatttgtcttagcggcttttgtcgttatcttatcagggctctcatttgcggagtttgcttcccgtatccctgtattaggcggtgcctattcgtatgtgtatgttgtatttggcgaatttgttgcatggctcgctggctggtttctgctatgcgagtttatgttggcagtatcttcggtggcctctggctggtccggttatgtccaagggttcttgacaagtatcggtgtgcatctgccaaaagcgctgactgctggctataatcctggcgaaggaacgtacattgatctgattgcaggattagtgatcatttttgtgacgatttgggtaagtcaagaagccaaaaaagccttgcgattgaacaatgctatggtttgggtcaaattcgggatcattgcgctttttatcttttttggggtattttttgtgaagccaagcaactggcagccgttcatgcctttcggattttcgggcgtctttaatggggcggcacttgttttctttgcttttttgggctttgatgcggtcgcaatggctgcggaagaagttgaaaatccgcaaaaagatgtgccccggggaattatcggttcaattgcgatcgctaccttattgtatatcgtggtcacgctgattttgactggaatcgttccctttaaagaattgaatgtcaatgatccggtagcttttgccatgcgatatatcgatcacggcttagttggttcggtgatttcggtgggtgccattttaacgctgctgacagtgacgatttccatgatgtactcattagcacgtttgctttatgctatcagtaaggatggcttgttgccaaaatcattgcaaaaaattaatcctaagcataagacaccgaaaaaagcgacttatgcagctggagtcgtcgccttcttttttgccgcagcttttccattgaatattttggcagaattaacgaatatcgtggcattggcctacttgatcttaatgtcgttggggatcatcaagctgcgtaaaatgatgggcatgcccaaaaaaggggaattcaaggtgccgcttgtgccagtcttgccattagtttctgttgctagctgtttgttcttgatgacgcgattgcagacagccacttggatcgtttttggtattacgatcgtcattggtttgctgatctattttatctatgggtaccgcaatagtgcattgaatgaagaaaaccagcaagagctttagtgtttgctaacgctcttgtttttgttcatgtcttggcaggaaaccaaaagtgatgacactgtaaaaaacgagcccctgagagattcccagaggctcgttcagctaatagaaaacagtattgcgtctgcctgaattatttgtttccagtcaagtccaacaagcgatctttgaggtcttcttccaagtgacccaattccacttcggccgctcggcgtttttcttttccttctttttggatacgcaatgtttcctgaattgtttcgacaagatcgttttgcgttttttgcagcgtttcgatatcaacgattcctcgttcgttttctttagctgtttcgatcgcagagaccttcagcatttcagagttcttacgtaagagatcattcgttgtttccgaaacttggcgttgtgcagtaaccgcatctttttgacgcaataaagtcagtgcgataacgacttggtttttccataaaggaatcgctgtattgacagatgcctgaatcttttctgctaatgcttggttggtattttgaatcaaacggatctgtggtgcttgttggatcgtgatctgacgggccaagcgcaagtcatgggtccgcttatctaagcgatccaaaaattgcgtatagtcattggcgatctgtacatccatctgatcattcgtttcttgtgcttttttcattgcttcaggaataatcgttgtttgtagttcttgcatttttaactcaccggcagcaatatagatattcaatgcatcgaagtaatctttgtttttttggtaaagctgttccaacatcaaattgtcttttaacagaccgtctttttctttgtctaatttaacagcgattttatcgatttgagcaccgattttttggtatttagcggtgatctcaaaaatcgattgtttgactttgccaaacatccgtttgaagagattgccttctcctgcacgtaattcatctggattagcttcttgcagacgatacatcaactctgtcaatgaatcaccgacaggtccgatatctgctgcttgcacatgattcagcatcgattgagagaattctcccagcttggtttgagcagctgcgccataggtaatgactgcttgttggtcggttggatcaatcttattcgctaactcttgtgcctgtgcttgtcgctcaggtggtaatttatcaattaagcgagaggctttttgttgttcttgcaaggcattgatctctgcctgctgggttgtcgtcaatgtatcgacaggggttgcaaatggattattcaatagatcatcaagagtatcgtttactggtttaacttgatttggtgtctccgtcattctaactcctcctaagtcttgtttcgaaaaaaatctagcctgggctagatttttttttggatcgcttcattcgaagatcgagcaaaggaatccatccctattcattatctcgttttatgctttgtttggcaatggataactcgatatcaagatcatctaaatcatctgccacaaactgctgataatctttagcgatcaacgaggccatttgttcaatgatttgagtgctttcttcgattttttcataggtttcacggcttttgatctcatgttcattgatctcaatgaatttgtctgtcaaatcaaccatgttcggcaaatgggtgtaaagaaaatgactcgccgaatgtaatttcgtcggttctttgaccaactctttgaacagtgctttcgaagcgcgtaatgcatcatgacgcaagtcgatcgcttttaatttattgctgcggttgatgtttttttgtaaatgctcgatctgttgtttggtttgattcatggtttctcggaacagttcgatttcacttggagacataccgcttttcaagtaatgcgcttctttttctttcgtcagtataggtaacacattgggatttgcttctaccttacgccccttcagaccaataaataccagaatcgcgccaacgatcagcaacaagacagtaaacaaatcagtgcctgtggaactgataaaggcaaaaagtgtgattacagcgatcgcagaaacgatcagccaaatattttttttcatttttcctcctcctaaaattctttggacaagtaatatagggattgttcgacatccttattttagcatgttcactagtagaaaaatatcagacttggggtggattttccgatatttagtaaaatcataatctttcttgctctttcttaaggagatatttttgagaaactatgctaaagtattttgtagaaaagacgttaaaggtcaggtgaaaaaatgttaacctataaagattttgaagaaaaaacgattgtcagaaacgagatttttcatggaaaaatcattgatgtcgttgttgatgatgtcgcattaccaaatggcggtactagcaaacgagagttggtctttcatccaggcggtgttgcagtgatcgctgtgacagaagaaaataaaatgatttttgtccgccagtttcgcaagccattagagaaagtcattttagagattccggcaggcaagatcgatccaggagaaggtgcacagcccgaattgactggtgctcgtgaattagaagaggaaaccggctaccgagcatcaacgttggaacatgtgcattcgatgtatctttccccgggctttgctaatgaagtgctgcatttgtttcacgcgaaacaattacaaaaagtagagaacccgctgcctcaagatgaggatgaagtattggaagtgtatgaattgacaatgaaagaagccaaagcagcaatcgcagatggaacgatctgtgatgcaaaaacgatttttgcgattcagttttgggagcttttagaattgaaacggaggaacagtcgtgcctaaagaaccactgatcacccgctctgaattgcgtcgacgtcgtgaagaagaaatggctgcttctgagcgaaaccaaaagatcgttgctaagcaagcaaacaaagagtggaagcaaaaagaaaagcaaatcgacaatcattatcggaaagtccgtaaaaaaaataaagcgatcactaaaacgagagcaggagaaaatcagaagtcccgcaacatgaatacttttttgatcaaagcaatcgtggtagtggcattgctgctgatcgtagttgcattagcgatctttttgctttaaggaacacgattaatcgggtttaattcgttgatcagcacatgtatctaatcaaaaaccagcacgcagagcatcagcgctcagcatgctgttttttttgttttatggctgggatggcttagcagcgctatatagaaaaagagcagcatcttgccccataaacaactgtggaccttcaaaaaatgtttcataacttactgaatcaaaacctactgattctgctagttggagcagcgtgtcttgctcaaatccattgtgtactttaggatgtgagacggattggtttttattgaaatcaacgatgaacaaacgtccgccgggttttaacaattgataaagttgctgcagtaaatgttctgtgtcgggaatatgaagcattaccagcgacaacagaacgatatctgcttcttcatgaatggactccttcgttaaatcgtggagtgatccagaaacatttgtcagcccttgctgggtgaccttctgatcaacgatcgccagcatgccctccgcagtatcccaaatctgcagttgcttgactaaaggggccagcggtaaactaacaagacctgttccgccgccataatcaataagaatttgttcacgggcattcatcagttggggtcttactgctgctgtaatcttttcagctagagcaatccttgggggtgtatcgtaatggtcggccattttattaaatatctcagacataaaaacctccttaatggtctgacaaaaaactgttcctttgagtaaaactagtttatcataaaaggagaaaaaatgatcttttattaagatataatgtataggatcgtcaggaggctacaagatgaaaattggtattatcggtgcaatggatgaagaaatcaagatcttgcgggaagcattggaagctcccttatcttgggagcgagctggagcactatttatttccggcagtatcggcaatcatgaagtgatcgttgttcgatctggaatcgggaaagttgccgcttcactgacaacaagtttgctgattcagcaatatggggtcaacatggtgatcaatactggatctgctgggggaatcggtgctggtttagccgtcggcgaccttgtgatttcagaaaaactagcttatttcgatgtagatgttactggatttgggtatacatatgggcaactcccagggggaatgcctttgtatttcgaggccagtcgttacttgatcggcgaaatgaccaaagccgcagaagcaacgaatcacaatgtaaaaaatggcttgatcgtaacaggggacagctttatcaatgacggacgtaaagtacaagaaatcctaaggcacttcccagacgctttggcttgcgagatggaaggtgctgcgatcgcccaaacagcgaagcaattcaatattcctttccttgtcgtaagagccatcagtgacactgcggatcatgctgcaacagtttcctttgacgaattcattttggaagccggcaagcgctctgcagaaatggtgctcgcctttgttaaaaagctgaaataaaattggaggagatcacaaatgaacgcattactctcaattgattatacggtcgattttgtagctgatactggtcgtttgacgaccggtcaagcgggtcaagcgattgaaacaacattagtagatcatacccaacgatttatcgatcaaggggattttgttgtctttgccattgatcgccatgaagcagaagatccttatcatccagaaaatcagttgtttcctcctcataatctggcagggtcagagggacggaatctctacgggacactagctgcagtgtatgaagatcacaaagaaaaagaaaatgtttactggatcgataagcgccactactcggcgtttagtggaacagatcttgacattcgtttacgggaacggggcattactgcactttatttgactggtgtctgtacagatatctgtatcttgcatacggctgtcgatgcgtataaccttgggtatcgattatttattttcaaagatgctgtcgcaagtttcgatccagtcggtcatgaatgggcgttgcgccactttgagcagacattaggggctactattctttaaaaaaaggagctgagtgtaatgggatttatggatcaattaaaagaacagtttagtttcagtgaattgacaggattgtatcagtcctataaaagcggtgaattggatgttgacaagattttgaatgatacgttcatgcaaaagtataccgattttgaaaatgtggaagcattgatgacaaaactaggcattcaagataaagatcaactcatggactttatgaaagatagaagcaaccggtatcatgctgaccaagtcgtaaaggaccattcccaatttgattctctaatcgaaatgatcaaaaaagcactaggaaaataaaatcaccgcccccgaaaagttagctgtttgctgctaacttttcgggggcggtcttaatattgtatcttttgatgaaggtgacggctgattgtatttctgaactactttggctaatgatgtgaggtgaatcctctttttttagaaaagttgcatcaacaaatggaccaatgattcataaccaaacagttcgtaacaaatgcctcgtagcaagctgtatcttaccagatttgaacacggtcttcaggagcccggtacatgccatctcccggttcaataccgaaagtagtgaagaaggaatcgatgttttgaacttggatgttggcccgtaacttggcagggccatgaacatcaatggccagcagcaactgttgatattgttctttggcttttgtgcgccaaatttttgcccaattgataaagaagtcttctagtgagacgtcagtttctttttctgctgcttctagtgcacagcttaatccaccagcatcggcaatattttccgatactgtcaaggtgccattgaccgttccaccagcaaatggcaagccgtcgaattcattgatcatttcttgagccaatgtctcaaaatgggccaggtcctctgctgtccaccaattattcaggttgccgaattcgtcaaatttggctccgttattatcaaacgcatgggaaatctcatgagcgatcactgcaccgatcccaccataattggcacttgctgattgagaaagactgtaaaatggtgcttgtaaaatagctgctgggaagacgatcacattcttgaaaggatgatagtaggcattgactgttgctgcagacatttcccactcctcgcgatcgaccggtttttgccatttgctaaaaagatcttcccggaagatacgtccaaaacgtagtgcattttgtaacaatgatgcatcagggtctgtgtgcagtcgatcatagatggctgggattttgtctggataaccgacatggattcctagtttatttaatttaacgattgctttttgtttggtatgctcgctgagccaagtattgctggtcaaacgatcttgatagacgccgatcatcgtttccaccatatgttttacatcattttttgctttttcaccaaaatacttgcgaccataataatcaccgacgacttgactaaattggccaattgtcagataataggcggctttttctttaggcatcgcttcatcaacgccagagaggtaccgattgtaggctccgccgagttggcgtagttcttcactaagatatccagtgtagcgcaaactttgatgaacgatcatccagcttttcaataaatcaaagtgggtaggagagacaatgatatcgaatgcctcaaagtactcaggctcagtcacgatcagctcttttggttcggcatttaataaagcggttaatgtctttttgaagtcgagttgcgccgaatgctgtgcaaaggtatctagactttgcggattgtaatttttgctgtaatcggcattttcttctgcactgcgaacatgaggagcaatcaatttatcaaaagccagtgtttgttctaccagcgactctgcttcggattgtgatttccctaatttcgttaagagcgcaacagcattgtcgaagaaaacttgtagtaactcttctgcctgcgggtggtcagtataatatgttttgtcaggcaagatcgttgctggcggataggccaacagtgtattcattttcgcgtttttcatatcggagtcgatatcgaaagcaaatggtagttggatgccgttaagaatgaattcaggtagctgtgcatttaactcgtcataagacgcaagggtttcgatttttgccaaaatcggcaaaacttcttgacctgcgttttcatcacgggtagcaaaatcgcttgctaagcgatagaaagcaacggcgtctttcatttttcctttaggaattgctaaaggatctgccgccatattcttgaactcagccatcatcaactgatcgattccgtctaccagatcttgaaaacctccagttgccggtttatccgcagggatcaccgctgattccaaccaatcgccattcacataatcataaaaatcatcttttaataatgttgtcatatgcttcgctcctttttatgctttctcctattatggaacaaaattttccagtacgcaaaaaaagtttgtttttttcttaacgaaaaagttccttagtgtctaaaccggctgattcccgtggtactattaagatatactttggtaaggaggaatggcgatggaagaaagagagaacatagatacttggcagggaataccagaagaacgattccgccgctacaaatcttgggtaacaccttccggctatttgtgcggaacttatgctgccaccgtgtttttggcttattatcaagattatatcgatgagcagatcatccctaaaacagtgagaaggaaaaatcagctgcagccgggcgcactgactgacatcttgcggctcttgattcaacctcatggattgccaacgattgcttggcaggtggctcatggactatcacgctttttcactcattttgatctaccttatcgggggcgtgccacagttttcggcggctggcagcgagcctgcaaacggatcgatcaaggcaaaccggtgatcgttggtctcttgaagcctttaggaagtacctacggcaatcactgggtagtcgcatatgcttatttagaaacagagaccggacgttatctaaaagttcatgacaactgggggaattacaatcaagtgattccagccagctggattaacggaactgtctcgttaccttaaattaatttaatgaaaaaagcacctataatgtgctagaataaaagaaacaattcacttcacttggaggcagacatgggcgaaagttataaagatagttcattgaagattttcagtttgaacggcaacagaccgttagccgagaaaattgcaaaagttttcggtacagagttaggtaagtcaaaagtaacacaatttagtgatggagagatcgcgatcaatattgaggaaagtgttcgtggcgatcatatttttatcattcaatcaaccaatgaaccagtcaatgatcactatcttgaattgttgatcatgatcgatgccatgaaacgtgcaagtgccaaaacgattaatgtggttttaccgtactatgcgtatgcaagacaagaccggacggcaaatcctcatgaaccgatcacggcaaaattgattgccaatatgttagtggaagctggggcgacacggatcttgacattggatctgcatgccgtgcaggtgcaaggcttctttgatattcctgttgataatctatttacgattccgcttttcgcgcattattatcgcgagaaaaaaatgatcggagacgaatatgtcgttgtctctcccaaaaatagcggagttcagcggacccgcagtttagccgaatatttagatacagcgattgcgatcgttgatcaagatgaggcagatggtggctatgtgattggagatgttgccggcaaaaaatgtattttagtagatgatattttgaatacaggcaaaacattgtcaaaggcagcagatttgctaaaagaagcaggagctagtgagatttatgcgtgcgtctctcatgcgttattgtcaccaccagccaaagatattcttgatcaatctgtcatcgaaaacatttgtgtcacagattcttgttggactgccgaagaacggcatccagaacggttgtcttacctttcttgtgcagaactgatgggcgaggctgtcaaacgaatccacgaaaatacaccgatgagtcccctgtttcggttagaaagcaaagaatacaaataagaagcaagagagttcggttattctggactttcttgcttcttatttgtcatgagacagtgcaatttatgctaagttattgaggttcaagacagtctctcgtttaatcagcttatgcgggacgacaagctgaaccgcatttgaaccttcatggtttaattgtgccatcaagctttctgtggcgatttttcctaaggataagacgttgatgtcaatgctggtcaagtaaggatgggtcaatgtagcaaaaatcgagttattaaagctgatcacagatagatcatccggaactttatacccgaacatcgttgccagttggatgatccgaactgcaaaaagatcatcgattactacgattgccgttgcttcggtctctttgatcgttgtctcgaaattgacatagtcttctgcctgttcaaatgtcaatgccggataaaaaggcaggttggctagcatcattgctttttgatagccaaagaaacgttcgaaatagagattttcgtgagttgtattcgtagcaaacaatatcttagagtgtccttgggagatcagatactctgtcgcttgttttcccagcatttggttgtcattatcaacaaaaacgatattttgttcattgctgtaaggatgtccaatcaatgtgaaaggaacttttttacgaactaaataatcaatgattggatctttttcatcggaatagactaagataaaaccatccacttgtttttgaaggtgcatacgttccacatttttcaataatgtatcaaaatcacgggcagaggcaaccgcaaccgtcatttggtggtggcgagcttcttcgttgatggcttcgatcgtttctaaatagaaaggatttcctagccgttcctttgaatccaaaggcggcaagataacaccgatcgcgcttgaaatctgcttgcctagatttcgcgcagccaaatttggcacgtagcccatctcagccatgattttgcgtactttcttttttgtgtcttcagagatactagggtgatcattcacgacccgagaaacagttgaagtagcaacgccggcttttttggcgacatctttgacagttacgctcactgttttccctccttttttagcttatagtatcataaagttgtgttattttggtagccggaaagaaaagaaagaagaaatgccttcatttcttctttcttggtttctgatcaataattaagcaatagttactgagacttcttcttccagcagatgctcttttccataaagctgaactgtcaatggctcaccactgattttctttagtgtgacagtttcttctttaacagaaatgaataataagcgtccgcgataattgatatggaaagcatagctgttccaagtcttcggtagaaacggggcaaaacctagatgggcatggtccgtcttcatttgggcaaatccttgaacgatcgctaaccagctgccagtcattgaagtgatatgcaaaccatcgtcggtatcattgttgtagttatccaaatctagccgagccgttcgttcatacatttccagtgctttttcttccattcccagctcggctgctaagatggcatggatactaggagacagggaagactcgtgcactgtcattggttcatagaagtcaaagttgtttcgtttttcctcttctgtaaattgatccccaaagaaatagattccttgtaagacatccgcttgtttgataaagcaagagcgcaagattcggtcccatgaccaattttgattcaatggcaagttttctggatctaaatcagtgactggcatcaaatctttgtctaagaaggtatcgtgctgaacgaaaattcctaagtcttgatcttctgggaaatacatattgtcaatgatatcctgccagtagtcttgctctttttctaggatcgttacggttgcttctgtggcatattctttataactttgtaaagtatagctcaagacccaggtagccatcttgttcgtataccagttattgttgatgttattctcatattcgttggggccggtaacgccatggatcatatatttttgctgacgtttggaataatggacacgatctgcccagaaacgagcgatggccgttaatacttccaagccttcttttttcagatagctcgtatcacctgtgtaattcgtgtagttatagatggcataagcgattgcaccatttcgatggatctcttcaaaggtgatttcccattcattgtggcattcgatccctgtaaatgtcaccataggataaagcgcgccagccaagccttgtttttgcgcattgatatgggcttgcggcaattgattgtggcgatatttcaacagattccgagtgatttctggtttcgctaatgccaaataaagaggcacagcataggcttctgtatcccaataagtagcgccaccgtatttttcaccggtaaatcctttaggtccaatatttaaacgttcatcttctccataataagtcgagaagagttggaataaattgaaacgaattccttgttgcgcagcagcatcgccttcaatgatcacatcagctagtgcccagcggtctttccaagcattgacttgttcttgccgtaagtcttcgtaaggtgcgctgtacacttggaaaagctctgcaatttttgttacttgatcatgaggattgacatcacgactggtaacgataatcacgtctttttgtaaatgaaagacagctcctgtttctcctgtaaaagtaaacgcgtcagcaatcgtcaattcactcgtctctgtggatgctggctcttgactatgacgcattgcggcagtgaccgtgaattgctcaatgtcaaagttgttttcaatggtacgggtggtcagataacgatagttgcctgagctgccgtggtctaattcttcccagaagcgttcttcgtaattactatcttcattgcggacattattgtctagtttagaaatgactgtgatttctgctgatccttcaaggatttctgcctgcatcgtgattaccgccatttctcgcttgacgatacttaaaaagcgctcaaaagtaaatttgacagttgcgccagctaatgaaaccgtaaatgtccggcgtaaaattcctgtttgcatatccagttccatataaaaatcgctcggactgattttcgcaagatcaacagcctgattgttgatgaaaagatccattgcaatgaagttaacagcattgatcacttttccaaaataatccggatagccatttttccaccagccaacacgagttttgtctggataccagacccctgccagataagtccctagatggtgatcgccactatattgttcttcaaaattaccccgcatccccatgtagccatttccaatacttgtaagcgactcttgtagtcggcgattttctttatctaaagtagttgttgcgattttccaaggatcgatatcgaacaaacgctggatttttttcataggtttttcctccaaaatctttttgataactctataataaatgcaaacgattgcgttagtcaagcgtaaatcattggtttctatgcttttttaaatagaagtgtgacaaagagctgtttttgcgcatttttataaattaatgactgaggagaatgtaaattgaaatttctcggtttacaaaattttcaatctccgctacaatgtggttattaagaaaccgattgcgtaaaacggtggaggaggaagaaagaggatgaaaaaattactaagctttgaattctggcagaaattcggaaaagcactaatggttgtggtagctgttatgcctgccgccggattgatgatcagtattgggaagacgatccccatgattaatgccgattgggcatttttggtaacgaccggtggtgtgatcgaaaatattggttgggcaattattgggaatctgcacttattatttgcattagctatcggtggtagttgggcgaaagaacgcgcaggcggggcattcgctgcggggattgcatttgtattgatcaatcgaatcacaggttcgatcttcggggtcacaagcgccatgctgacggaagaaggggcttttactcatacattgttcggtacgaaaattatggtggatggcttttttacaagtgtcttagaagctccggcactgaacatgggtgtttttgtagggatcatcgccgggtttgtgggtgcgactgcttataataaatactataatttccgcaaactgcccgatgcgctttcgttttttaatggcaagcgcttcgtcccgtttgttgtaattgctcgttccgtggttgttgcgatcgtgttagcgatcgtttggccttacattcaagcaggaatcaataactttggcttgtggatcgcacaatcgcaagaaagtgcgccgattttagcacctttcttgtttggaacattagaacgattactattgccatttgggctgcatcacatgctgactattcccatcaattatactgaattgggaggcacctatacgatcttatctggtgcacaagcggggacacaagttttcggtcaagatcctctatggttagcttgggcaactgatttagtcaatatgcgaaatgcaggggatacttcacaataccaattcttgatagagaattttgtgcctgcacgtttcaaagtcggacaaatgatcggttcttctggtattttgatgggacttgcctatgcaatgtatcgcaatgtcgatgcagacaaacgccataaatatacctcgatgtatttatccgctgccattgcggttttcttgacaggtgtgacagagccattggaatttatgttcatgtttgcggctgtaccgttatatgttgtttatgcagtcgttcaaggggcagcatttgctatggcggatatcgttcacctgcgtgttcactcctttggaaatatcgaactattgactcggacaccaatggcgatcaatgcaggtctgggtcaggacttgatcaattttgtcctagtaacgatcgcatttggggtcggcatgtatttcttggctaacttcttaatcaaaaaattcaactttgcgacgcccggacgcaacggcaactacgaagtagaaggagctgacgaaaacgtagcaacaactgcctctgacggaacgttagatccaaactctcaagtggttaagatcattcatctgttgggaggacgtgaaaacatccgcgatgtagatgcatgtatgactcgcttaagggtctctgtcaaagaccctagctcagtaggagacgaaaagtcttggaaaggtgctggcgcattaggtttgatcgtaaaagataacggagtgcaagcggtatatgggcctaaagccgatgtacttaaatcagacatccaggatatcttggattccggtgtggcgattcctgaagcagtcataaaagaagtcactaatgagacgaatcacgaaagccaagggataaccgctgaggttgtttcagtagccgatgggcaagtgattccgatcacggaggtcagtgatcaagtctttgcagagaaaatgatgggggacggatttggcgtgattcccgataacacgcaggtgtattcacctgtctctgggaaagtgacgaatgtttttcctacgaaacatgcgattgggttgctatctgatgaaggagtcgaagtattggttcatatgggcttggatactgttgaacttcaaggggcaccattcacagtttctgtcacagaagggcagcaagtcacaaaaggtgacccgttggctttaatggatctcgcagctatcaaagaagcgggtaaggatacaacgatcgttgtagtaatgacaaataccgatcaaatcgattcctttgaattgtcccaaactggtcagcaaaaagctgcagcagttgttggaatcgtcaaactataataaaatgactaagagctgtgccataagtattttaccaaactgaatatccaaacgatcgtggggttgctacagtctggtagtttctcgtcgcaattcacgagaagtacagctgatctcatacagtgcggatagtttcgtctggttcatacttatggcacagctccgttcttttatttacattttgaaagaagataatcaaacgcagaggagcgttattcatgaaagttttaacattaaacacccatagctggttagaagacgatcaagaagcaaaattaaaagtgatcgcacaagaaatcgcagcaggagattatgatttgattgcgttgcaagaagtcaatcaatcgattgctgctacaacgatcgttccggatggtctttattgtccgacagaggcgatccttgagatcaaagaagacaattttgctttgcgcttagtagaagaactgcagattctggatcacgattattattggtcatggacttacagtcatgtgggttatgatgtctatcatgaagggaatgccttactgtccaaaaatccaatcattgccaaagaatatttggcttctgagacaaccgatgtctgggaccatactacgcgaaaaaatcttagcggtctcacagaagtagacggcaaaatgatccaagtgttaagctgccatttttcttggtggaatgacggcaagtttgcctatgaatggcagcaaaccgaagcgtttttgactgagcgagcagcatcgctcttgcttttaggtgatttcaataatgaggcagacagcttgggttatcagctggttaaaaacagttcattgcagctgcaggatagttttcttgccgcaacaaaaacgatcggtgaggcttcggttgttaaagcaatcgatggctggcaagacaatcagacagccttgcgtatcgattatgtctttgcctcacagaatgaacagcccgtagagtatgaagtggtctttgacggtcagcggctgccgatagtcagcgatcattttggtatctgtgtggtttttgaataaccaagaatagagacgacttcgattattcgcttgctatcacttgaatcggctagagattcaggaagcagacaatcgattaaaaaaaggatgagaccagaaacgaatttctgatttcatcctttttattttgatcaaatgtcaatcgaaccatagcggttttttaaggcagtgcgtattaagcgttctgccaaatgttcattccgggcaagcagtggaccatggaaataggaaccaaaaacattgcggtagaccacgccttctgtttggtcctcgccattgtttccctgcccttctacgactttacctagtggtttctcacctttgccaagaaacgtccgaccattgtgattttcaaaaccataataggtctcatcgaattcttcattatggataacgatatctccgatgaagcgattgttttcttgactcaatgtgtaatgatccaatgcgctaattcctttgattttctctccgttagctcccatgtagtaatgacctaacaactgatacccgccacaaatggccaacatgactccatcgttctcgatgtattccgtcaatgcttctttttttgtttggatatcttcagaaacgatcagctgttcaaaatcctgtccgccgccaaaaaagactaagtcatacttcttcggatcaaatggttcatggatgctgacgacttccgaaatgaattctacacccattttttcggctacataacgcaacatcaacaaattgccattatccccgtaggtgttcagcaaattcccgtaaagatgagcaacattcaaacgataattagccacgatccatcccccctttgatatagcctttttctgccaattttttgcgtagttgcaaaacagcagtataggttgctaggatatagactttttcagttggtagattggcgatatctttaatgacctcatcaagatcttttgtttcggtgatcttttcttcgggaattcccgctacttttaaacgcagcgtcatatcttgatggcggtcgccgccagcaatgacttgaggaatcgccatttcggcaaatgcttcatgatttccatcccagatccagctaacatcaatgccgtccgcataatttgcattcaagagactgacgagagaaaaaggatacggagataagccgatcatatcgatcacttgattcagtcctaccggatttttgactaacacgagtgtacactctttgccatcgatggtaatgacttcttgacggccaaagactttttcatcataggccaatccagctctgattttttcaggtgcgacttgataatattccgctacagcggtcgctgccaatgcattatagacattgtacatgccgccaacttcgattccatatgaattcccatcaatgataaaatcagcagaagtattgtccattgctgtgatggctgtcaatttgtagtctagttttggacgtttgaagccgcagttcggacaatagtatttgcctagattcgcataggtaatcatttggtaatgtaagatgtggtggcattctggacaaagaaccccgtctgtattgtaatgggccatctgctcctgattaggtaagtgatcaaagccataatactttcttggattaacagtagtgacagaattgaacaacggggaatcaccattacatagaattgtggccgtcggtgaatttgctgctccttcaacgatcattttatatgttgtatagatttcaccataacggtccatctgatcgcgaaaaatattcgtgaagacaaatagttcaggtttgatatacttcgttactttgctaagactagcttcatcgatctctagtactgcaaactttttgccgccttttggtttggcagataagaaagtagaaacgattccttggaccatattggcacctgttggatttgtcagcacatcatcaaattcttgccgtaaaatattcaccgtcagtgcagtagtcaaggtttttccgttcgtaccagtgataacgacaacttggtaatcttttgctagatgatctaaaatatgcggatcgatttttaatgctattttcccaggcagacttgatccgcctttaaaaaagttttttaatacccactgagaggtcttaccgactgtgacagccagttgacttcttaaccccatagttgaacctccaaacgagatgattgtctttttagtttaaattcaatttatcataccatatgttctaaaaaaggttaaacggcttttcgatttctttaagtttctgcaaagagttcagtttattgaaccaaaaaaggcagagacattcgttacaaacaagatgtctctgccgcttcaaaacgcttgtggaaggctcgcgactttaagatacaacgcttagaaccttcaatagcgccattttactggctgtttaaccaataataatcttctcggttgggtattcataacctaaatctcgggtttcttttggcacaaacaacaacaacgtataaagcatacctacacgtccaatgaacatcagtaaggctatcactaacttacccacacttgagagatcatcggtgatccctaacgataaaccggtggtcccaaacgcagaagctacttcgacaatgatggcgatcaacgggatatcttcagtggcagtcaaaaataatacgcagaaaaagcacattcctaaggataacatgaagacaacaaccgacttacgcacatcgtcttcatcgatccgtcggccaaatatgttgatattgtcttcactctttaagaaggcataaagataaagaccaataatggcgatcgttgtcgtacgaatcccgccaccaactgaacttgggctgcaaccgataaacattagtaacgaaaaaacgatcaatgtcgtagtctgaaagttccctaaatcatggatctgcagtccagcattacgggtagtcatggaataaaacatactgttgatccaggtgctgctaaagccgtaatctttgaacagatggtctttctctaggaaataaatggcgatcgttccaccgataaacaaaatcacaaaagccaacatcgcgatttttgtaaacaatgaaaagcgaaaaggcagttgtcggcgattttttttcagcttgaagagggcccattctcggaaatccataatcactggaaacccaatcccaccggtaaaaatcaaaaacatgatacaaatcaaaaagaaataatcatgtgcgaaaggtaaaatggaatttcctgtcacgtcaaaaccagagtttgtgaccgcggaaatagcttggtaaaaaccataaaatagggcatcccgccaattgtcataatagccattaaagtaaaaataaatagaaaaaatagcgccagagatggcttggcaaagtaagatgatcgtaaacgtgattcgaatcatccgcacgattccgcttagctttggctgattcatatccgtcataatcaactgacgctgcttcaatgagatctttctccgagaaacgatcgcaaagaaagtggagatcatcataatccctagtccacccacttgaaaaagaacttcaagaagcactacaccgcgatcattgaacacatcatcgatagggaatgtcgtcaatccggtgacactgaccgtgctgactgccataaaaaacatatcgatgaaggaagcatgagaacgaggttcacgaaaaaagggaagataaaataaacctaaggaaataatcgtcatcagaatatagtaaaaaacgatcacttggatcgaagaaacattttgggcaataaaatatttgcttttgcgttgtgtcagacgagcaaaccgcgtgaaattcataactagtctcctcactaaataaactacccacagtataccaaagaaccaagcagtttcaaaagaaagcaagattgaaagtaagtagcagccaatatcatcaaagaaacgctctgcaaaaatatgagatagtgccgcaaaacaattaatggaacagagaagacgatagcctgtcattgagagagtactagaagatagcggtgagccggacaaaaaactgtatgcccgataagtctgttgggcatacagtttttttgaagagatcggttagttagagtgcttccaccgcttcgattgcgcgaaagactttttctggagtgatcattgggtcgatcaggacaaatgtttcttcttctttaacggcataagtcaaaacaggcgcaaaataagcgcgatccacacgagtgacatgcaagtcttttagtttcataggtaagtgcaatgcttcgtagaaaggacgcagttcctcgataacagcaaaatcgttggtgtaggcaagctgtacccagatgcagtaggccactttattgccatggaggacactgtgggtttcgctcagataagataagccgtcatgtaatgcgtgggcgccagaagttctgccaaactctacagcaaatccaccaacttctcctgctaaagcgatgatggcatctgtgattcgcgcaaaagctggcgtcaagcgcccggcttctaaatcagtgactgcttggatggcatctgcgatcaagagttctttgattagttttgcactttgaaaaccgagccgaaccaaggctgttttatcttcttctgccatcgtgcgtacaatggcttccatttcataatacttggctagcgtgtctgcgatgcctgcaatgaaataatccacgggtgttgctagcaagaatcgagtatcgacgatcgtcatataagccccttttttggcgtaatcgatcttgcagattgtgtggtctgggtaataggcgacaatcacaggagtaaagggtgcacagttggaaaccaatgtagggatgacgatcagctccgcttccattctttctgcagtaatttttgcggtatctgcgacacgtccaccaccgatcgcaagcaggacatctgcgtgtttgatcttatccgctaactcctgagcattctcataacttgaggagccatcatagcgataaacaggatagtcaaatggatgcggataataggttttaaaaacgtcaaatgattgatcgccagtaatgacagcaacctgatcaaaatcattgagatactctggtagatcaaaaagaactccttcaccagtaatataccggtttggtccagggcggacttcattggctaacataacacaacactcctttgcaatcgtcagaattttctaattagtgtaacgtggaatagcgcctgctgtcaatttttcttttgagcagttttgttcagatcagccaggccaaagccaatcggcgcaagcaggcgtaaagagggcataaaaaaagaccctaacaaaggagagtttgttcttgctagtcttcgcataatcaagactgttttgcgaagatcctctccttttgagggtcagttgttgggcgagaaaacagcactatttctatctcagaaactaaaggaatattcaaactgccgcttctcaaaataggttatgtccagttttgacggatgaaaccagctcgtcctgaaccttcacggtaggcgttgtaatgcgccgtatttttcttataaaaatcttgatgatagtcttctgctggatagaaaggttcagcaggttcgattgttgtcacgattggatctgtaaagcgaccgcttgcttgcaaagcggcttttgaagcttctgcgatttttcgttgttcttcactattgtaatagatgactggacggtaagagtccccacggtctgcgaactgaccaaaggcatctgtaggatcggtttgttgccaatagatagccacgagttcttcatacgttatttgttcaggatcgaaagtgatttctacggcttctgtatgtcctgtggttccagttgttacttcttgataggtaggatgagggacatgtccaccggtaaaacctgagactaccgaaagaattcctggtaaagaatcgaaaggtttgaccatacaccagaagcagccgccggcaaaaattgcagtatctttcattgtgattcctcctttggttttatggtatgcttcttatagagaaagacaagcgatatgcttataagaaacggccaaagaaagcgaggtttgctgtggatacgatcatcattttattgcgggggaattctggcagcggaaaaacgacagtagcaaaagcgctgcatcaacaattaggggcagaagcggtgttgatctcacaggatgtatttcgccgagaaatttttcacgtgaaagatacgcctaataatcatgctgtaggtctaatgatggaggcccttttatatgcgcgagggaaggttcctttcatcatcgttgagggaatttttgcccgtgaaaaataccaggacttcttgctctttttactagaatcctttgagaagtgtctcatttattattttgatgtgccttttcaaacaacgattgaaagacaccgaacacggccgcaacgggtatttttttccgaatcatcgctacaaaagtggtggctcgaaaaagaccttctctttggggaaaacggcatagcgtccaagagcaatgatacgagtaataaatcagtcctctcaaaagagaagatgtttacagagaagcagacaatatctgaaatgatcacgatgatcttggaggatacgaaacagtttcaaaaatagccttgaagcaaacgatctgttttccaaaaaaactaaagtgaggtatctctatgttagacaaatcaattccttatgcagaaatttggatggagcgcatggctgcggatgaagtagcaccggtccctgactcaaataactacatcattcaaccttatcaatccggtgatgcgagtgagtgggcgcggattgagacagcggtgggagaatttgatacagaagccgcggcacttgcgtattttgaaaaagactttctcccctatgaatctcaattgccgcaacgaatgttttttgcagtggatccagaaggaacaaaggtaggaacagcgactgcttggtggaagaagaagcaagatggcaacattgtgccgctcgttcattgggtagcagtcattcccagcgctcaaagacaagggatcgctcgcggcttggtaaccaaagttatagaaacatgccagaaccaaacggcagattccgaagaatctgctgccgctatttttctccatacgcaaacatggagtcatgctgcgattggactgtatcaacaactaggcttcaaacttattgatacagactatcagggacagatgaatcccgagtacgaacaagtattgactattttgagagacgtggcgcagaaggaaaacgggcagtaaagccaatcatttgcaggcatcgttctgttcagtacccctcttagcgacttctgaatttaaacctgtaaaaattccttgttttcaagtataataccaaaggagtatcaggaaggatgggcaagatggcacaacttttttttaaatatggcgcgatgaatagtggcaaaacgatcgagattttaaaagttgcacataattatgaagaacaagacaagccggtcgtgattatgaccagcggcatcgatacccgaagcgggatcggaacagtttccagtcgtattgggttagagcgtgacgccattccgattttcgatgagaccgatttgtatcatttagtaaaagatctaggatatcaaccctattgcattttgattgatgaggcacagtttttgaaaaaacaccatgtcttggcgtttactaaaatcgtagacgaattaggcattcctgtgatggcatttggtttaaaaaatgattttcgcaacgaattattcgaaggttctaaatatctgcttctttatgcagataaaattgaagaaatgaaaacgatctgctggttctgccacaaaaaggcgaccatgaatctgcattacattgacggtaaaccagtctatgaaggcgatcaagttcaaattggcggtaatgaagcctattaccctgtttgtcgcaaacactattttcaccctggaatcaaaaaagaaggagaataaaacatgtacgatcagttacaagcgattgaagaccgttatgaagaactaggcgaactgcttagtgatcccgctgtcatttcagatacgaaacggttcatgcagttgtccaaagaagaagcaaatacccgagagactgtcgaagtgtatcgccgttacaaagaagtcgttgaaggcatcaaagatacagaggaactattgggcgaaaacttggatgcagaaatggcagaaatggctaaagaagaactatctgacttaaaaaaagaaaaagatgttcttgaagaccgcatcaaaatcttattattaccaaaagatcccaatgatgacaaaaacattatcatggaaattcgcggggctgcgggtggagatgaagcggcactatttgctggagatctctttaatatgtatcagaaatatgcggaaacacaaggttggaaagtcgaagtgatggatgccaacgttaccggcatcggcggctacaaagaagtcatcatgatgatcagcggtgagaatgtctattcaaaattgaaatatgaaagtggcgcgcatcgggtacaacgcgtgccgtcgacagaatctcaaggacgaatccacacatctacagcaaccgtagtcgtgatgccagaagcagaagaagtagagatcgatattgctgataaagatatccgaacagatatctatcatgcttcaggcgctggtggtcagcacgtcaacaaaacggcatcagctgtccgcttgacacacttgccgactggtatcgtcgttgccatgcaggatgagcgttcacagttgaagaaccgtgagaaagcgatgaaagtcttgcgggcaagagtatacgaccaaatccagcaagaagcacgaagcgaatacgatgcaaatcgtaaatcagcagtgggaactggggatcgttctgaacggatccgtacgtataactttccgcaaaatcgggtgacggaccaccgcatcgggttgactatccaaaaattggatcaaattttggctggaaaacttgatgagatcattgatgcattgatcatgtacgatcaaacatcaaaattggaagaaatgcaaaatgggtaaaacctatcgagaagtcctttcacgggcttcttcttttttagaaacaaagggactggaagggtatgcgatccaatacctttttctggctcgtaaaaattggcaaaaactagattggttgctgcatatggatcagcaaatttcgccagctgataaagtgcaaattgaagcagatctgcagcagcttttagcgcatcgtcccccccaataccttttaggctatgaagagttttatggccatcgcttcaaagtaacagaagacacattgattcctcgaccggaaacggaagaattagtcgctttgtgtctggagcaaacagaacctgcagagaatttgcgggtcgtagatattgggacagggacaggtgcgatcgcggtctctttgaaattggcacgtcctcactggcagatcgctgctgttgatctttcagaggccgcattggcggtagctaaagagaatgcggcgcaattaggtgcggaggtcgctttttatcaaggcgacacgctgacaccagtgggggatcaatcatgggacatcattgtatcaaacccgccttatatcagtgagcaggagtgggagctgatggatgccagtgtgcgtcagtttgaaccccaaatggccctttttgcagcggagaatggtctagtgatgtatcgtaagattgcagaccaggcaaagaagttattgacacctgacggaaaaatcttcgtcgaaatcggttttcaacaaggcaaatctgtccagcgtatttttgcggaagcttttccagataaaaaagttacggtcattcaagatttatctggaaaagatcggttggtcgcagtacaataatccacagcatgtggacaaccatttttttgaaaaatttttttgataaaaaacagtgatagagtaagacttacttgcgaataaaagttataaacagggttatccacacttgacaaacgatttatccacaaaatgtggataaaaaccgaaaaaatgttgataagtgtggaagtcctcaaaaaaaggatgtggataaactgtggaaacaaaaaaatttagtgaagaacaattatccgaagcagcaaaaattttagccgcgggtggattagttgcttttcctacagaaacagtgtatggcttaggcgctaacgctcttttgcctgaagcggtagcacaagtctatgccgtcaaaggaagacctagtgacaacccattgatcgtccatctcgccgacccggaacaactgaaggattatgtggataacttgcatccagcagcggaaaaattgatggcaaagttttggcctggccccctaacattgattttttctatcaaaaataacagtttaccgtctattgtgaccggggggttatccacagcggcattccgtatgccagcgaataaaaaaacactttcagtcattaaacaggcacatgtcccactagtcggacctagcgcaaatacctctggcaagccaagtccgacctcagctgaacatgtattgcatgatttgaaaggaaagatagctggtgtgatcgatgatgggactactaggatcggagttgaatcaacagtcttggatttaagtgatccgacagcaaacccaatgatcttgcgtccaggagccgtgaccaaagaacaattagaaacggttttaggcagtgaagtcgaaatagataaacacctagtatctgaaggtgaaagacccaaagcaccgggaatgaaatacaaacattatgctccggatacaaaggttgtgatggttcggtcagaggactggccagcagcactcgattgggtcaagcagcagcgattgcgagcaggtgtcttggcaggcccatcaatttgtgagacagccagatttgaaacagcagctgtttacatgtatgcggacgacacggttgaggcagcagcaaaaggactttttgcaggtttgcgagccttagatgaatcgatcgctggcttggagatcattttagtgaccgcttttcctgagacagggatgggcagcgcctatatgaatcgcttgaaaaaagcagccaatcaaaatttttttcaggtaaaatagaaaaaacgctgctttgatcataggtagtgcttaggaaatatgatacaatgctagcattaaggtaaaggggtgttgtatgaatggactatcaaacgtttgatcctgatttatggcaagccattgaaaaggaagcggatcgccaacaaaacaatttagaattgatcgcatctgaaaatatcgtttccgcaggtgtaagagcggctcaaggcagtattttaacaaataaatatgccgaaggatatccaggtcgccgttactacggtggttgtgaatttgtcgatgttgttgaaaatttagcaattgatcgtgccaaagaactttttggtgcggcctatgcaaacgtacagcctcactcaggctcacaagccaatactgcagcatatctagcgttgattgaaccaggagatacggtgatgggcatggatctatccgcaggtgggcatttgacccatggctctccagtcaattttagtgggaaaacctatcactttgttagctatggcgtagacccagcgactgaagtgattgattataatgtcgtacggatcttagcgagaaagcatcaaccaaaattgatcgttgctggtgcaagtgcgtattcacgaacaatcgattttgccaaattccgtgaaattgctgatgaagtcggtgctaagttgatggtagatatggcacatatcgcaggattagttgctgctggtctgcatccaaatccagttccttatgcagacatcactacttctacgacccacaaaacccttagagggcctcgtggcggcttgattttgaccaatgacgaagacttagcgaaaaaaatcaacagtgcagtctttcctggcattcaaggcggacctttggaacatgtggtcgctgccaaggcagtcgcattcaaagaagcattggatgaagacttcaaatcctattcagagcaagtgatcagaaatgcgcaagcaatggcaaaagtgttcaatcaagcaccgcaagcacggcttgtttctggtgcaacggacaatcatttattgctgattgatgtgcgaggatttgagcttaacggaaaagaagccgaagcattgcttgaccaagtcaacatcacagtcaataaaaattcgattccatttgaaacccttagcccatttaaaacgagcggtattcgtgtcggcacaccggcaatcactagccgtgggttcaaagaagaagatgctgtggaagtagcaaaactgattgtcaaagtgttggaacaccctgaagatacggctgttttggaagaagcaaaagcacaagtgaaagagttgacggacaagtatccgttgtattaagatgtagcaggaaaagggtttgagccgatgctcagatccttttttgaaggaatatggctatgacgtgatgcaaggttgtatcaatcgttgatttgctttaaaataaaagaaaaaccaaaggagacttttaaaatgggtaaattccaagtaattgaccaccccttgattcaacacaaattaacaatgatccgcgacaagaactgtggaacgaaagtgttccgtgaagttgtcgatgaaatcgccatgttgatggcgtatgaagtatcacgggatatgcccctcgaagatgtagtgatcgaaacaccgatcgaagaatcgacccaaaaaacacttagtggtaaaaaagtagcaatcgtaccgattctacgggccggactaggcatggtcgacggtattctagagttgatcccagcggctaaagtaggacacattggtatgtatcgtgatgaagaaacccttgaaccacatgagtatttcgttaaattgcctgaagacatcgacactcgtcagttatttattgttgatccaatgttagcaactggtggttcagcgatcatggccatcgatgcgttgaaaaaacgcggtgcttctaacatgaagtttgtttgcctagttgctgcgccagaaggtgtgaaagcattgcaggatgcccatcctgatgtggatatctacacagcaagcttagatgaccgcttgaatgaacatggctacatcgttcctggattaggcgatgctggtgaccgtttgtttggaacaaaataaaagaaagagcgtggaacaaaaagtgaaaaacacttttgttccacgctctaaacacgtctaaacgctgggagtaggagcaactccttcggaaataaatcgaactactcaaaaactactcaaacatttgaaaagcaatttccgtgtattcctccttatttcttggagattaccacttttgtcccagtctccttttgaacgaactacattttcgttaactgtttataattaatgatcaatacaccattactttgtgtaacaagcttttgattctccgctgtctgattcaattcaacaaccgcagagttcttaagctgcttagtgactgtaccggtttgttttattccatggatcgtgaacatgacaggagtagcgacctcaaaatttgcaccttcagctgacgggacaacggttgtttcgaacttaccaaatgttgccatgtaaaaacctccttgatatagttaaattataccacattttttgaaaattttcagtaatcctattttttccctaaacttctctttacaaagttgtgtttttttcttataatcttctttgtgttagttgccagcttagctcagttggtagagcaacgcactcgtaacgcgtaggtcacaggttcgaatcctgcagctggcattgaagcagtctaattagactgcttctttttttagatgatttttttagagaaaactttaaagtttctaaattttttctgaatgagaacggggaatcctttcttttctgcgcaaacatcactataatggataaagattctacagaagagagtgtgggcatggaaaatacacgaataaaaaagaatgataatcgaattgactacggtgtgatattacccgtatttttattgtgcttgattgggtttgcgtcattgtatgtcgcattgacgaatgatccaaggaatccatccgtgggaaaaaccttaggatttcaagctttatggtatgtactaggagttatcgcaattatagtgatcatgcatataaaatccaagtggttgtggaagttgactccctatatttacggagcaggattgctggtaatgctgggtctcttgaagttctatgatgcagggttagccgactctacgggctcgcgaaactggctgcgttttggctcctttacgatccagccttcggaattgatgaagattgcctttatcatgatgttggcgctggtggtcacccatcacaatgttcgtcatcgagatcgagatttaaagacggatggcttattgatcgctaaaatgttagctgtaaccattccggtcctagttttagtcatgctgcaaaaagactttggaacgatgttagttttcttagctatttttggtgggatctttttgatgtcggggatttcttggcagatcgtgatcccagttatcgccgcttttgttttgatagggggcgggaccatctttttagttacaacagatatgggacgagagtttctctataatgtcggctttaaagaatatcagtttgcacgtatcgattcttggttagatccgtttcacgatactcaaggccagtctttccaactagcttatgctttaatggctattgggtctggtgggatgttcggtaaagggttcaatgtgagtgatgtctacgtgccagttcgtgaatcagatatgattttctctgtgatcggagagaactttgggtttgtcggcagtgcctttgtgattttattatatttcattttgatttaccgaatgattcgggtttgttttgatacaaacaatgaattttatgcctatcttgctaccgggatcatcatgatgatcttgttccatgtctttgaaaatatcggtgctaatattggcttattgcctttgacaggtattccattacccttcatcagtcaagggggatcggcattattaagtaacatgatcggcattggcttgattttatcgatgcgctatcaggctgagagtacaccaaaaaccttgtaaggagatagctatgatcacattttactggtatccgaaatgcagtacatgtaaaaatgcgaaagcttggctagaagcaaatgggattccctatgaggccattgacatgatcaaagaggtgcctacgaaggcgcaattgttacaatggatcacctctagcggcttgccagctcgccgcttttttaacacaagcggaatgaaatatcgtgaattaggtttgaaagagaaagtaccaacgttgtcaaatgaagaagccgcaactttgttggccacagacggcatgttgatcaaacgcccattgttgattagtgaagatcgctttttgatcaatgggtttaaagaaaaagaatatgaaggagtcttgttagaatcatggaaaagaaatgcttgagaaaaaaagataatttgtgggtactgttcaatggcaaagaatactgtgttggtttgacaaaagaagcacaagaagaattaggtgctgtgtcttttgcttctttgaaaaaagttggtacagccttgaaacaaggagatacgctagtggagttggaagcagaaaaagctgtcagtgaatttccaagcccattaacaggcgtgatttcttctgtaaatgaaaaaatcgatcaaaacgttgatatcttaaacgacagcgatgaaatgaacgcttggctagtcagctttaaagatgttgatccaagtcaatttgacgaattataaaacaagatccaaccactgatttacaaaaagaattgacagcagattgagacgttgctataatttgctcaataaatgaatgctttgaaaagaagagtacatgttcttgacgtacacagagagccctgtttggtgtaaatgggcaacgaagagaagatggaagatggtctttgagcaggatgggtgagtctaaggacaagcctatcacgggatgcacccgttactgtgcaacagtatgcgaagaaattcaagtactggaagaggctgttgatgcgagtcgacagtaaatcaaggtggtaacacggaagttgtgctttcgtcctttgtaacagtataatgtacaaaggatgaaagctttttttgtgtttaactagtgaatgaataaagaaagatgggaaatttatggcattaatcgaattgacccacgtaaagaaatcctttgacggtaaaagtggcgcagtccatgccgtcaatgatgtttctctgcaagtggaaaaaggcgatatttatggcatcgttggttattcaggtgccggcaaaagtacattggttcgtctattgaatggattagaacttccttcagctggtgatgtagtgatcaatggtcaaaatattttagccttgaagaacaaagaattacgagattttcgtaaaaaaattggaatgatttttcaacactttaacctcttgtggtcacgaacagtattggaaaatatcgaattaccattagaattggcagggatccccaaaatcaaacgccgcgagcgggcacaagagctggtaaaacttgtcgggttagaaggacgcgaaaaagcttacccttcccaattgtcaggtggccaaaaacaacgggtaggaattgcccgtgcgttagcaaatgagccagaaatcttgctatgcgacgaagcaaccagtgctcttgaccctcaaacaaccgaagaagttctggatttactgctgtccatcaacaaaaaactgaatttgacgattgtactgatcacccatgagatgaacgtgattcgcaaaatctgcaataaagtagctgtaatggaattaggcaaaatcgttgaagaaggttccgtacactcggtgtttcgtcatccgcaacaagctgtgactaagcgctttgtgcagcaagatttggagccagaagaagatcccgaggaattgcgtcaagcctttttaagagaaaatccccatggccgcttagtgacattgacctttacggaagacaatgcgaatgaaccaatcatttcgcaagcgatccgaaagtatctgattgatgtcaatgttgtttatggcaagattcagcaaacgaatgaaggctcttttggcgcattaaccgttctattgaccggtgaaacagcagaaatcgataaagcattgcgcttttttgcgcaagaacaagtaggcgtggaggtgatcgagcgtgggtaaatcattttcagaaacctattttgattttgaaaaaatcgattgggcaaacatgcaacaagcgacgatcgatacgttatttatgacattcttctctatggtactagtcattgtgattggactaatactaggattggctctttattcattaggtcgcaagcaaacatttggatcacgctttgcctataccttagtctcgattatcagtaacgtgtttcgttcaactccgtttatgatcttgatggttttgattataccgtttacgacactattggtaggatccttcttaggggcaaaagctgcgattccagcattggttctatcagcagctcctttttatgcacggttagtagagattgcctttcgagaagtaagtccaggtgtgattgaagctgccgaggcgatgggagcaagttactgggagattatttataagattatcattcctgagagtgtcccagcattgatttcgggcatcactgtcaccaccatttcaatgattggttacacagctatggcaggggcgatcggtgccggaggccttggttcattggcttggcaagaaggctttcaacggggaaattacactgtgacgcttgtagcaacagtgattattttaattattgtctttatcttacaagcaatcggcgactttttgacaaaagcaacagacaaacgctgattggctgaaaaagaaaaacatcaaacagaaaattgggaggaataaaaatgaaaaagatttttggttttgcaacaacagtattgttaacagtcgctttagcagcctgcggtacaggttcaaataacagcgccgattcaacatcagctagtggagaaaacacgaaattggtggtgggagcatctgtcacaccccatgcagaaattttagaacaagcaaaaccattgttggaaaaagaaggaatcgatttagaaatcaaaaccttcgatgattacatcttgccaaacaaagctttagaaaatggcgatatcgatgccaactatttccaacatatcccttacttgaacaagcaaattgccgataatggctatgactttgttaatgcaggagcggttcatatcgaaccgatggggttgtattcaaaacggatctctgacatttctgaattagctgaaggtgcaaccgtgattacttcaaattcggaatccgattggggtcgtatcttaacgattttacaagatgctggtgtgattaagttgaaagatggtgtcgatgctgaaacagcaacatttgatgatattgctgaaaatccaaagaaattagaattcaagcatgatattgatccttcattattggcaacggcttaccaaaatgatgaagcagacctagtggccatcaatgcgaactttgcttttgggatcgacttgaatccagcagatgattctgttttattagaagcggataattcaccatacgtcaatgtgattgccgtacgcagtggcgacgaaagcagcgataaaatcaaaaaattggttgaagtgcttcactctgacgaaatcaaagactttgtcgaaaaacaatggcaaggttctgtgaaaatcgttgatgcggacgctaaatagtttccttcattaagcagtacaaacagagcagtgacataagttaaaaacagacgaaacttactaaatgataaagagatttgaccttcctcgcaatcttgcgtcgaagacctcctgaatcgcaggagtaatctctttacgtttcggttaggtggtttgtttcatacttttgtcactgctcttttttaattccaatctagcaaaacagaacggttatgccaaatcatttcatacagcagcggcaattcagggtgcttttttaataattgatcgtagtgggggagctggctaagaaacagacgaatgagtgtgagggtatcaggtgaaagtgatccactccctttaaacaagatcagattgccttccaataaagcacagagcaagtggatttgagtgattttgacaagacagatttgaaaggagtcacttcccagacgttctttgagcagttctgcagcaaatatttggttcagcaagtaggtatcttcttcagataaatagaaggcttcaagtccaagtaattgtttccataagaaaagatagttgcgttcatggcgcaaataaaaggcagggacaaagttttttggaaaaactgtagctaatgcgatcccattttccagcggataaaccgcttttcttttttcatggattgttttgatacaaaagaaggcctcactggaactttttatcaagtgtggacgcatccagcgcaacaattgataatggaaaaaacggatttgtatttcgttcccttgtaaaagtggaaaatgcttgcgattcagagataagtgatacgctgccaaagaggatgatagagcagtgaaacgtcgattgacactggaagggctcaggtggcattttctgcataataatggataagtcaacgaaggttcttccagctgggtgttaagaatacggtagttactgctcttttttacaagagaagcgatgactttttttttaactcagtaaccgacattgcttccgtctgtaaataatcaagttggccttttttaatcaaaaatttgattggtaacttgatacctaactcgctggcgatcatccgtctaatagtcttgacggagatcccttgttgcagggctgcttgttggagggggagcggcctttctttgaaaagactacggatcagacgcaacatgcgcaacacttctttctcgagaaaatcctccaagttgtgaatcacctctttcggatgagattacatttattatagtggataactagtttcttggtttttttagaaaagaataatcatcaaagtttaataaataattttcactacaaagagacagatgtggagctaatcagcttaaaagagaaaaaaatgaagaaaataaggaaaaaaacagggattctggattcatagtagggaatgatggaaggggaaattgggtgatcctgcaagcagtgtcgcttaaaagcagactcaaaagaaccgcacaactgaatagctgaaaaatagtagggcaacactaaaaaactactaggctaagaataccttaagcctagcagaaagtgtctagctatccctccctcgctggagatttggtacgtaatgcagagaaataaattatagaaaatcagcttgcttcactaggcaataaaatggtttggcgctgaccatcatcataggcataaacggtttgaggcaaatactcattgtaagcaatcggcagatcgatacacatcccagcacggcgatcatcttgtgaaaaatgaatactaacacggccgtcattattttttacgtgaaaagttaatagattttctaacggaataacgcctttcagatccaagtcaatgatcagccataaactatcgatcaattctcccggcatggtttggacgataccgccagaagcatagcggctgcggctactgtcaaatggttcaaacatggttgttccctccttgaggataaagtcggtcgtgggtcggcaatcgaaagatagaatcaacttgtttaaaataagaccactcctcaaggaatggtcttattctttacttgtagcaaaaattattcttgatcttcaccaataacagctggttctgctgcttcaccgttttcgtcatcttctgaaagttcttgtgcttcagcaacagcaacgatttgttcttcggcttctgtgacgatcgtataatcatcatttttctctaaatcgcctacagtcaacgcgtcaccaatttcaagtccagtgacatcaacttcaatacgttcaggtaatttatctggtgttgcggatacaacgacactgtataagttttgtgtcaatacgccgccggctttcacgcctgctgcatcaccaactaaggtcaattcagcttctacctcagtttcttcattcatatcgactgagatgaattcaacatgggtcaatgcacgagtgaacgtgtctgattgaaattctttgatcagtgtatttactttcttgccttctaagttcatagtgattacggtattcaaaccattttcacgtagcagtctttctaattccgctgcattgactgcaatcggagtactgtctacttgataaccattcacgatagcaggtacttttccttcgtgacgcaatttgttccgtaatgaacgggggcgaacttctcttttcgtaacttctaatgatactgacataactcaattcctcctaaaatttcccgaaaaaaacgggatgtttttaagcaaattttgttaactctgcacattaagtggtacgtgagtaaaaacacgcaaaagggcagttgtttacacaactgccccagaaagttttggttcaacttttctccaccaggtcgtaacgctgtgtatgagaaactttatttactttactctttaaccttacgtggaaagtcgaagaaagtcaaatgaaatgatgagtcgaggatttgcaagcaattaaatctgagctataatagccaagatggagagaaaacaatgcgtatagacaaactgatagaagagcggttagcgacctctcgcaaagaaatgaaacgtctttttcaacaagggaaagtcttggtggatcagcaaatcgaacggaacccatctcgaaatgtcgacagtcgattgcatgaaatcaaggttgctggggtactgctgcaaacaagagatgtgtattacttactcaataagccagcgggggtggtgacagcaaatatagatcaccagcacgccacagtcattgatcttttacagccagaagaccgacaggcgacactttatgcagtgggacgtttggatcgcgatacagaaggattggtattgttgacgacgaatgggcagttaggctatgaattattgcacccaaacaagaaagtgccgaaacgatacgatgtcattgtcaatggtccggtaacagcggaagatgtggctgcttttgctcaaggcatcgtttttcatggaggtgtcgtttgtcagcctgccaaattgaccatagagatgacttcaggtaggcggtcctttgttcatctagagattgctgaagggaagttccatcaagtgaagaagatgtttttagcaagagggaaaaaagtgattgccctaaaaagagttgcaattggtcctttggaactaggggatctattgtccggagaataccggaatctcacccaatttgaattagaaagcctagcgaattattttcgctgagaaagaggagactatgacttataaaacactgttatttgatgtcgatgatacgattcttgatttccaagatactgaacatgaagcgctgacagctctttttgcggaacaaggtctgacgatggatctcgaaatgaaacagacttatcaagaggttaatcacggattgtggcaacaatttgaacaagggaagctgtctagagaccaagtagtcaatgaacgatttggcttattttttaaaaagtatgggcgaatcgtcgacagtgaagcgatggaaaaacactatcgttcttacttggatcaagggcataaattattaggcaatagtcagctagtgttggccgaattggctgacaagtttgatttatatgttgtgactaatggtgtctctaaaacccaataccgccgtttgtcagatgctaagttgatgccttattttcgggatatctttgtatcagaagatacaggttatcaaaaaccaatgaaagaattctttacctatgtttttgaccggattcctaattttgaacaacaaaaaacagtcattattggtgactcattgtcttcagatattttgggcggacatttgtcagggatcgatacaatctggctgaatcctaacaaaaaagcggcttcaacagttctcccaacctatgagatccagtcgttggatcaattgccatcgttattaaaagactgatttcttagaaatgaatagtaatttttcagaatttcgctataatagaaacagtgtaaattttagagacgaaagaggttaattgaatgacgaatggcaagcccattattattggtgtgactggtggttctggtagtggaaaaacaagtgtgagccgagcgattttcaatcactttcccaatcattccattatgatgcttgaacaagactcttattataaagatcaaagcaacttgagctttgaagaacggttgaacacaaactatgatcatccgtttgcctttgataccgatctattgatcgaacatctgcagaaactccttgcctacgaaacgatcgaaaaaccggtctatgattatgtggcacatactcgcagtgaagcaacgatcattcaggaaccaaaagaagtgatcatccttgaaggaatcttgattttggaagacgaacgtttgcgagacttgatggatatcaaactgtatgtagatacggatgatgatattcgaatcattcgtcggatcaaacgagatatggaagaacgcggacgaacgctggattccgttattgaacaatatttgacagtagtcaagcctatgtatcatcaatttatcgaacctacgaagcgctatgcagatgtcatcgttccagaaggcggcgagaaccacgtagcgattgatttgatcacaacgaaagttgcaacattcttaaccgaaagctgagcatcttttctttcgaaaacacttattaaagaatttttttgataaagcagtagtttttctttatcaattatggtaaagtatacctcatgcgacgagtcgagatggtctagctttgactgaccagattgataacagaggcacaaggagcgatccacctgccggatgcagggtgtcggaatattccttttgtggagatagggtattctactagtaatagtactgtgaataaaaaacagctttgaacattcatgttcaaggctgtttttttgtctatttctgtaggggatagcgatagatcatcgattcttctccccaaggatgatagcctgtacccatcagctcaaaaccaaatttttcataaaacgaaacaagatctgtacataaataaagggtcgagaaaccagcagtagcggcagattgcttgatagtatcgatcaaaagccgagcaccaccttgtctgcgatagtgaggatcgacatagagggcgcgcagccaaggcatcaaatccattcggctgataaaatcattcgtgatcagtccaccacagccaatgatcgaggggacagcagcggcttggttatccacgagtaggaaccattgcggtagatcggtatcagcaaaactgtgggtcaagctatcttcatacactttcatggatgcgggactcgcccattttgattgaaaataagcgatcgcttcctgtaaatattcaggatgttctcttaaatgaatgactttcatttttatcccacctttggcaaacggatttgaaaaataacgcctttaggttgtagatcacgtacactgatttgccctttgtgttcctccacgatttgtttggcgatggccaaaccgagaccatagccgccggtttcttttgaacgggagcgatcttcccgataaaagcgttcaaaaatatgtttcttgtcttcatcgctaatagatggacctgtgtttctaacttcgagcagccaatacttgttggaaatttctgacagcagtgtgatcttatctccttgacttgtatatttcagggcattatccaataaaattactaatacttgatgtatttttttggggtcgaagacagcagttgtcgtagctaggttttccaagacaaattgtttattattcattttggcaatctcttgaaacggttttgccagttcttgaatgaaaggagcgatggcaatggtttctttggctaacatctgctggttggaatcgctgcgggcaatcgtcaataaatccgctgtcaatccagtcaacctccgggtctctgctaatgcttgagcaatactttctgattcctcaatgatcgtatgattgggcttagtgaaggtgcgctctaaactgttttggatgatcgtcaaaggcgtccgtaattcatgagaagcattttcgacaaattcttgctgttttttccacgaagcgaggatcggccgcattgtcaatgaagaaaggtagtagctgataccgattgacaagatccaaaagaaaatcatcgataaaatcaaaattgtttgaaagttgttcattgcattattgatttggttggtattggccaacacttgaacataggctacccctgattggttcgtaggcgcggcaaccgtgatcgagtgaaacagcaaagtctccgcttcattttgatcgcttacggtcagtgattgaatcgtatttaaatgttccgtatctaatttgagtgaagctagctgagagaaacgtccgcctaatgattgtttgtttactatcgtaccgtcttctgaccaaagaataaattgggtgttgaaacgattggttccaggaatctttggcattgctgtattgggcggtaaggcaatggcttcgttttgattagcgttgttgatctctgcttggaccagacgtgtatcttggacggcttgttcaagggcaatatcggtttcttgatatgcagattgatcaaataattctagtacaatgattccgagcaatgtaaagatcaatgcaaaagcgctgatattgatcaagaacaatttaagtcgctgtttcttagagagttctttgttcattcgctaatctccttgcataatatagcctacattgcgcagtgtccggatctctttatcaataccagtatcccgaagatgtttgcgtaaattgctgatgtagacctcgactactgtgatcgttgtttctgaatcaaatccccaaatacggtcaaaaatttgctctttcgtcaaaataatgcctcggttttgcaaaaaataaacgagtaatgcaaattcttttccttggataggtaatagcttttcgtcaatcgttacctcattagtagagagattgcaggtcaatcctttatagaccacttggttttcattaaataaacccaatgaacgttttaacaaggctttgcaacgcatcaataattcttcccgataaaaaggttttgtcaaatagtcatcggcgcctttttgaaagccagcgaccttatcttctaatccatctttggcggttaagatcaagactggtgtctgaacagtgtgctgtcgtaattttgccaatacttcatagccattcatttctggaagcatcaaatctagaatgatcaaatcataaatcccactttgggcttcatacagaccttcactcccatcaaaagcttggctgatttcaccaatttctgcaacgatttctttaatattttctgataacgttctgtcgtcttcgatcagtaataacttgatcattctgtcacctctttcattataagcatagcatgagtaacataaaaaaaacttaaaaaagtgatttttgcttaagctgtctttaagtttcagcgtcttaaatagggactatagcaatcaaaggaggaaaataccatgaaattaaaaaaggtatttcaacgaaaagaaaccaagtatcttttatcgtctgagcagtttcagccgtttctgggtgcgttgcagcagaggatgaagattgatgaatatggccaacacacgattctatctctttactatgacacggatgattttcgtttcatccgtcattcgatggataagccaaagtataaagagaaatttcgcatccggagttatggtgttccatctcaggacagtttggtgttcctagaaatcaagaagaaagtcaatggcattgtatataagcggcgtgttcctctaagctattcagattatcaatcatggatacgaagcggggaatttcctaccactattcaaccacttcaaattgccgccgaaattcgttggctatttaaacaaaaccatgacttaagtccgcgcgttttgattgcctatgaccgcctttcgctttttgcatcagaagacagtgaatttagagtgacctttgatcaaaacattcgttatcgggaaaacaatctgacattgtctgaagggagttatggacaattgatagcgccagagattggtgtgttgatggaagtcaaagcaatgggggcctatcccctttggtttgttgaacaattgaatcagtatggtgtgcgcaaagctagtttttccaagtatactcaaacctaccaacgtcatttgtttaaaaaggaggatattcagaatgttatctagtttgttaagtgataccgctactcttgaatgggatggcttgattatttgtattagtgcctcactgattctgggtctcttagttgccggagtgcatatggtaaagaatgtttatacaaaaaattttgtcattacgttggcagtactgccggttctagtacaatcagtgattatgctggtcaatgggaatttaggaactggggtagcgattttgggcgcattcagcttgatccgcttccgttccgttccaggaggttctcgcgaaatcaccagtgtgttttggtccatggggatcggcttagctaccggtatgggttatgtcggttatgtggtggttttttcattcgtggtagctgcctttttattgatgctgtataccgtaccctttggcgaacgacgtaagacgagcgaacgggaattgaaaataactattccagaagacttagattatccccaactgtttgatgacatttttgagaaatttactcatacagccaagttggattcggtacgcacaacaaccatgggtagtctctacgagttacgctatcacttagtattgaaggatcaaacacaagaaaaggctttgatcgatgatgtacggacgcgtaatggcaatttacctgttgtactcggtaaagttgcggctaatcgtgatgaattataaggaggaagaccaatgaaaaaaatctacccattgtttttggcactgttactggtagcttgtgcgcagcaatctgaaacaaattcttcaagttctgccactggaacttcggaagcaacggttacgaatggatctacttctttggaagatacagattattatggaaagtatgaagaagaggatttggatgcttcttatgagtcatcttcagccatagcgataaaactggcgggttcacaaacggaagctggagaaggatttacagttgatgatcaaacagtaacgattacttcggcagggacatatatggtcagcggttctttgacagatggtcagttgaaaatcaacgtcgacaaagaagccaaagttcatttgatttttgctggagtaagtatcacgaatgctaacagttcagcagttgttatcgagcaggcagagaaagtcattacgacattagctgcggatacaacaaatacgttaacggatggaacgagttatacctttgcagaaggagaaaccgaaccggatgctgctttttatagcaaagacgatttgtcgatcaatggagaagggaaattggtcattgaaggcaattatagcaacggtatccgcagcaaagacgatttagtcttggcaagcggcacctatgaaatcacagcaaaaaacaatgcgatcaaaggaaaagattcggtgtcgattcgagatgggaattatactctgacgacttctgaaggagatggtatccaagccaacaataccgaagatgctacaaaaggctatattgggattgatgggggtatatttacgatccaaagtggtcgggatggtatccaagctgagacaaatcttagtattcaatcagcagaaatgaccgttaagacagctgatggtgcagatagtcaagcggtcgtcgctgatgaaagttataaaggaatgaaagcaggtggatccatcctactagcaagtggttcctatactatcgatagtgcggatgatagtatccacgccaatgattcagtcaccatcaatggcggggagatttcagcagcgactggagatgatggcattcatgcagacaatggtttaaccattaatgatgggacgattattgtcaacaaatcctatgaaggcttagaagcaagcgtcatcaccattgctggtggagatattcaagtgctagcaagcgatgatggggtaaatgccggcggcggcagcgacacgacggacagcggacaatttggacaagatagttttggaggaggaccaggcggtggcgatcaagcagacgatagcaaagaagttgtcatcacaggtggaaccttgtcaattgatgctgaaggagatggattggacagcaatggcaatgtcacaatgagcggtggaatcgtgattgtcaatggaccgacgcaaggcgggaatggcgctttagattataatggaacctttgaaattacaggtgggaccctcgtcgctgcaggaaccactgatatggcaatgaatgtgagtggcggaacacaacgatcagtggcgattactttcgatcaatctcaggcagcagacacgttgatcaccttgcaagatactgagggcaatacgttattatcctatgcacctagtaaggattttcaacatgtggtgatttcaagtccagatttacaatcagcagactatacactacttagtggcggcagcaatagtgaaacttctgtttatggtctttatcaaggaggaagtgtgaaggatgcttctgaattaggcacattatctttaacagataccctttcaaatttgactcaatctggcgcaactgccacgacaaaccaaatgggcggatttggacgctgatcaattctagtagccctcgttggaggaaccaaagaaagaatactacgaacgatgaccgctacaacttagtttattcttgctatacatgattggtaaaaagccattaaagtgtaacattctgaaaggatattctagccctccatttccgagattgaagcagacagtgtctaaagatatcgtggatagaccatgcctattttaaggtgtacttaagctagtaaacatatagtcaagctacgtttagtagaggaggatatgagatgaattttatgaaacgcggcttacaaagtttgtgggcaaagaaaggtcgaagtttgctgctaattgctgttttttcggcaattttgatttttgttttagcaggattgacaatccgcagtgctgctttagtcgcaaccgaaaacgcacaaaaaagcgtgggagcgacggtgacgctgcaagccaatcgggagtctcttcgacaaaacagccaaacagcttcttcagatacttcagagggggagtcgacaccgcccgatccaggcagtttccagaatacaccggtaaatcttagtgatgctcaagcaattgcagcgttaagtggggtagcatcctatagctttgaagcgagtacatcagccgatgctgtcagtggcattgaagctatttcaagtgaggatgacgaaagtacagcgacagaatctacggaggattcatctagagcaacgaatggccagccaagtgggatgcctaatatgcaaggaggcagaatgagcagcggcgattttcaaatcactggtgtttccgaaagtacgaactatacaagtttttcagaaggcaccgcgaaaattaccgatggtgaagccatcactgcaggagatgaagggacgaatcatgtcttgatcgaatcagaattagcagaagcaaatgggctttcagttggcgacaaatttgttatttctgatagtgaagacaatgaagtcgaagtaacgatcaaagggatctatgaaaccagtgaagttgggaacagtatgagccaaatgttcaattttttgaacccagccaatacattgtttgcatcctatactctcgttaatacattggcgggtaatgaggatacgttagattcggcgacttatacgttgagtgatccttcagaaatggacagtttcgttgctcaagctgaaaaactgattgataccgatacctacagtatccaaacgaatgatcaaatgtatcagtcgatgttgacaccattgaataatgttgcaagttttgccaaaaatataattgtgctagttgcggttgccggtgtcatcatattgacattgatcgtaatgttgtcgatcagagaacgcaaatatgagatcggcgttctgttatctttaggcgaatcgcgaataaaagtcattttacagttttttaccgagattgctatctgtatgttctttgcattgggaatcgctgcagctagtggcaatgttgtagggaatatcgtgggcgagcagctgttggctcaacaaacgacaacggaacaagcggacgcagggatgaatggtccggaaggaatgccaagtatgggcaacggcggtcctaatggcagaagcgggctatccgcttttacaccctcggcagaagtacaagagttagctattacggtttcattccaagaaatcggcttattggcattgttaggtgtagggatcagctttgggtccattctattatcttcagctggaattttgcgcctcaatccaaaaaaaatattggtttcctaggagggatagcatgacgttacaaacagaaaaattaggttattggtaccaaacagaatctgaagccctttttcgagaagtagatttgacctttgattctggaaaaatgtacgcgatccttggttccagcggttctggtaaaacgacctttctctcattaatcacgggattggacacaccaaaagaagggaatatttattacgataacgaaccgttgaacaaaattggattgcgagaataccgtcgtaaagatgtttctatcgtctttcaagcttataatttgttgccctatatgtcggcactggataatgtgactaccgcaatggcgattgccaagtcacaacaaacagataaaaaggcatatgctttggcaaacctggctaaagttgggataactgaagaattagctatgaagaaagttacccagctttcgggtggacagcaacaacgagtggccatcgtccgggctatatgctgtgaacatgagttgatcgtggcagatgagcccaccggtaatttagatgaaacgacctcaaaagatatcgttcaactgtttcaagaaattgcccatgaacaaaagaaatgtatcatcttagtgacccatgaacaagaagtagcgaaagtctgtgatgttgtttatgaactaaaagagcgtcaatttgtcatgcgggactcctaataaacttgttactgaaagactaaactcaaggctgtattttctcatcagagcggatacagccttgtcttgcatcttgcagcagaaacttctacaataaaaggaagggggcgagacgatgcgattactgatcgatggggatggttccccagtaaaaaacgaagtcattgaattaggtgcgcagtttgcattgccagttgtgatcgtcactagtgtcgatcactatacggccaaagaatatcctgattttgttcattttgtctatgtggataagggggccgatcgagccgactatgagattgttaaagaaattcaaccgggcgattttttagtcacacaagattatggcttagcttcacttgtattaccaaaaaaagcccgtgtttttcatcataacgggacagaatatttgccggagactatcgactttttattagggcaacggtatttaggaacacaaatgcgtaaagccgggaagcggaccaaaggaccgaaaccattcacgaaagaggatcgtcaacaattcaaacaagttctagagcaagaaattaaaaagacgatccagcagtaaccatcattgaggagactgctggatcgtttatttttttcgaaaacgatcataaaaatattttccggcaacggtgacgatggccacaaaggctatacaatagccaaagatacccatttgatgaacaaagctgccctgttggggacttgcaacgactaaaagagaggaacctaaaatcactgctgctaagataatgccaatcactagccgattgatcatttgatcaaaacggtccagcagctgtttttgatggcggatctcaatattcagacgatgcttgccagtagctagtgtgttgacagcagctaatgttcgatcagggagtcgactgagtgctcggagacttttggcactggctaacaaactttttttcatttcttcttcaagatccagctgctgcaaaaagtatttctgagcaaatggctgtgtcacttccatcatcgataattgagggtcaagtgcctcgattactccttcaagcgttccgaaagctttaatcagcagcgtgatgtcacggtgcatctgtagatgattgtcatgacagatagtgatgacttcagctaatactttttgcaaatcaatatctttgatcggcatgttgtaataattttcaacaaaagactgaagatcttgatagaaatccacttcatcgaagtttctttcccgacggcaaaggcgtaggacagctctaccaacttgttgggtatcttgagtgtacaatgcgatcaaggcatctgccagccgactgcgaagggtctggtccagatgtcccatcattccgaaatctaaaaagatcaagcgataaggcggcagtgtctcctcatcctgccattttaaggagtaatcaacaccgcctaaaacaccaactttcttttttacatggaaaggagctgtttgctgatcgggatccagtggttgcaagaagatatttccaggatgagggtctgcatggaaaaagccgtcttcaaagacttgcttcataaagttctctaccagcagggtaccgacctctttcttgatttcttttactgtccggttgggaaaaaattgttcattgttttttcgagcaagcaaacagtttaggttttctccttccatatagtccatgacgatgactttacgtgtacaccactgaggatagactttaggaatctcgatctgctgccagtggtgattgaagtgataaaactcttgcgcatttttcgtttcttgcagaaagtttgtttcattatccaatgagcgtcgaacttcatgcagaacgcttttaagatccaccacattcgtttctggaatatagcgaatcaaaggaatcgctttttcaaacaaatcgagatctacttggatagcggaaataatgccgggatgctgtactttgacaacaacttctttgccatcttttagagtcccacggtgagcttgaccgatagatgccgaagctaagggcttttcttgcaaagttgtaaaaatggctgtcagaggttgttcccattctgcttctaacagcgcctggacttgcggaaaaggatcgcttttgacattgtcttgcaagtgtttgaattcattgataaaagcgtcagataataagtcgctacggacggaaagcatttgtccgattttaatgaaggtgggtcctaattcttcaaaggctttgcgtacagcgaggggatcttgctgcttacttaaattttgaatcactttgtatttgagaaacacttgaacgatctgtctgagtctttttttcttagatggtgattcctgttccatacgggcacctctattctttaagtttcgctagtctaatagtacgaagaaatcaagaaacattcaactacggatgatttcagttgttaaaatcggcaagaaataatgtcgcagcttcgtttttgtgctaaaatgtggaagaattagttttggtagaaacaatgaatacaggaggaatttcttttgaaaattattttattatatggcggacgcagtgcagagcatgatgtatcgcttctatccgctttttcagtagtcaatgctgtatattataattactaccaagtacaattagtaatgatcacgagagatggccagtggctaaaaggctctttattgactgaagcccctacatccaaagaagtgttgaatctgacggattcggcttaccaagggacgccgatccaacctggtgagatcaaggaagaggatgcgattgtttttccgctgctccacggaccaaatggagaagatggaacgatccaaggttttctagagaccatcggcatgccttatgtaggcgcaggggttttaactagtgcctgtggcatggataagattatgaccaaatatatcttgcaggcggcggggattccgcaagttccttatgtacccgttcttaaaaactattggaaagaaaatcctaaaaaagtatttgaacaatgtgaaggcagtcttttgtatccaatgtttatcaaacctgccaatatgggttcaagtgttgggatcacaaaagctgaaaatcgggaagaattgcaaaatgcacttcaagaagcctaccgttatgatacacgagcgatcgtagaacaagggatcgaagctcgcgaaatcgaagtcgctgttcttggaaatgaagatgtgcgtacaacaatgcccggcgagatcgttaaagatgtagctttttatgattacaattcgaagtatcttgacaataagattgagatgcagatcccagctcaaattcctgaggagacacaagcgaaagcgcaagagtttgccaaaaaagcttatacgatgcttggaggaagcggcctcagccgctgcgactttttcttgacgaacaaaaacgaattattcctgaatgaattgaacacgatgcctggttttaccgagtttagtatgtacccgctgttgtgggaaaaaaccggtctgccatatggtgatttgattgaggaattgattcaattaggagtcaaccgttttaaacagcgtcaagcctttttaaccgatgtcgaataatcacaaatagggaaatcagttcaactcaaggtgaagcttgaaaggaccatgatcttccctgtttttaacttaaggagataaataagatgaatctatcgataaaagaagttgccgctttatttggcgtagaatgtgccgatcagacaatgatcagcagtgtagaatttgacagccgcttggtcactaccgatagtttgtttgtgccgttggccggaacgagagatggccatgagtttgctcaacaagcacaagaaaaaggagcaatcgctgctttttggagccatccgacaatccagccgccagaaggactaatgatcatcgaagtatcagacaccctagctgcctttcaaaagctggcaaaattctataaagaaaaactggcgccaaaagtaattgctattacaggtagcaatggtaagactaccacaaaagatatggtagatgcggtggtggcacagcagttcaaaacctacaaaacacaaggaaatcacaataatgaaattggtttgccactaacgattctgcatgcaccagcggatacagaagttcttgtattggagatggggatggatcatgcgggggaaatcgaggtcttgtcacacttggctcagccagatgttgcagcgatcacattgatcggtgaagcccatattgagaatcttggttctcgtgaaggaatcgcgaaagccaagatggaaatcactgccggcttagacccagcaggatttttcatgataccagcagacgagcctttattgaccccctaccttgcagagttgactcagcaggtagaaacatttggtttgggtgaaggcaatcttaaaggaacgatccaagaagaaacccaagaacaaacagcttttacggtagcggatcaagtctatacgattccagtgatcggcggctacaatgtaaagaatgccttgatcgcgattggcatcggtcgttatttggggattgaagaagaaaaaatcaaagcaggattggctgattttcaactgacaaagaatcgtacacaatggctgaaagctgcgaatggcgccgctattttaagcgatgtctataatgcaaacccaacagcgatgggattagtcttagacagtttcagaaaattgcctctgactggcagacggatcgctgtgctagcagacatgttggagttaggtcctgattcagcgaagatgcatgccgcgatggcggatcatttagatgaaaggttcgatttgatctttttgtacggtagtgagatgcaagcgttgaaacgtgcattggatcaaagccgcttagccgatcgagtccatttctttagcaaagaggaaaaagcggcgctgatcacacaactacaaaaagaactgcagcctacggatagcattgttttaaaggggagcaacggaatgggcctggttgaggtaattgattctctaacagcaatgtaaagtaagcgtgaaatcttgctgaaattttcattctgtgctatacttatttaatgccgaaagatgaagcacagaatgattactgtaaataaacattgacgttttgagataaaatgatggctgagacagaaagatttgttttagccttttataatgccttcgtgaagcggtttttcggtaacaagagaaagataagagatgggactgctcttgtgtttctgaagaaagtacgcttcgattaaagaaaacaggcatcatgatgatgaccaaattaggaggatccatttgaaatttaaagatctagaattatcaaacgaattattgacttctgttgagcgtgccggctttgaagaagcaacaccaatccaagaagcaacaattccccttgcgttgcaaggaagagatgtcatcggtcaagctcagaccggtaccggaaaaacagcagcattcggcttgccaatgttggaaaaaatcgacccagcaaatcaccaactacaaggattagtgattgcacctactcgggaattagcgatccaaacccaagaagaactatatcgtttaggaaaagacaaaaaaatccgggttcaagcggtttacggtggtgcggatattggtcgtcaaatccgtcaactaaaagatcgtccccatatcgttgtcggtacaccaggacgtatgttagaccatatcaaccgccacacattgaaacttggcacagtggaaacacttgttttggatgaagcagacgaaatgttgaacatgggcttcttggaagatatcgagaagatcatcagccaagtacctgaagaacgtcaaaccttactattttcagcaacaatgcctcctgcaatcaagagcattggcgtaaaattcatgaaaaaccctgaacatgttcaaatcaaggcgaaagaaatgacggctgatttgatcgatcaatattatgttcgttcaaaagactatgaaaaattcgatattatgactcgtttgttggatgtacaaacacctgagttgacgatcgtttttggtcggacaaaacgtcgtgtcgatgaattggcacgaggactagaagctcgaggctacaaagcggaaggaatccatggagacttgtctcaacaaaaacgaatgagcgtattacgttcattcaagagcggtcatttagatattttggttgctacagacgttgcagctcgaggattagatatttctggtgtgactcacgtctacaactatgatattcctcaagatccagagagttatgttcaccgtatcggacggacgggccgtgcaggtaaaggcggaatctccgtaactttcgttacaccaaacgaaatgagttatttgcatgttattgaaaatctaactaaaaaacggatgtcaccaatgcgtccaccaaccgaaaaagaagcttttaaggggcaattaggtgcagcaattgaacaagtagaagtgaaaatggatgaaaacgggttggataaatacctccaagctgcagatgatttattggaacgctactcagcacaagacttggctgctttgcttcttaaaacaatcgcgaaagatccatctgatcttgtccctgtgaagatcacaccagaaagaccattaccgcaaggaaagaaatctttcaataaaaatggtcgtcgcagcaacaacagcaacaaccgcaaccgtaaagacaacggcggcaaccgcagcggcaaagctcgaggaaattacagcaaagacggcgctcgcaaaaataaccgtcgcagcaatgacaaaaaacgcggcttcgttatccgcaacaatcaagactagtccttagaggtcgctttcagcacctttttcgacacaaaattatctgaacttttttcgatcaacctgccaatgtgtgccactgaccaagaggccacttggcgtgatcgatcattgttcggatattttttttgccctttttgagaaaagacggtatagtcaaggaaaactggagaacgagcctctcaaaaatttcttaaccatccattaaaccctttagttttgagtggtaattccctttttttttggtagaatgaaactaaaataaatgcagctgatgtattaaatagatagatataaaatcgtaatgaacagtcatggaataaaggttcttgctgaacagaaaaggatagaaaatgatcaaaggtatcgggatcgatgcagtagaattagcccgcatcaaagaattgattgaaaacaaaccgcaatttattcagcgtattttaactgagaaggaatctgaactgtttttcaagctgccaaaaaaaaggcagattgaatttcttgggggacggtatgcttgtaaagaagctttttcgaaagcttggggaacaggaattgggaaattgtcttttcaagatatcgaagttctgaccaacgaggctggagcgcccgttgttacaaaggcacctcaccctctacatcagacgtttgtcagtatcactcataccaatgagactgcctttgcgcaaatcttgttggagaatgaataatgccagagatagcgattcgttaagggaatcactagagaaagaaggaaagtggaatggtcgtttcaatccatagaccaacgaaagccattatagatttaaaggcaatcaaagaaaatgttgaaaatgaagtggcgcgtttgccaaaggcaacggatttatttgctgtggtcaaagcaaatggctacggacatggggctattgagacagcaacagcagctctagaagggggcgcttccggtttttgtgttgcgacagtcgatgaaggtatcgagttgcgggaagctggattcagtgaaccaatattggtgttggggatcgtttctgtggcagatatcggtttgctgagctactacaatctttcatttccagtaagtacgaacgagtggttgcaagaagcggctgctttcttgcaaaaaaatcctgtcaccaatccgctgaaggtccatttgaaagttgatacaggaatggggcgaattggctttatttctaatgaagagttactctcggctgtcaaatggctccaagagcagtctttgttcacatgggaaggggttttcacccattttgcgacggccgatcaagcagatgatacgtattggcaagaacaaaatcaacggtttcaaaccgcattggcatgtctgcctgaattgccaaggtatgtccatgccggcaatagtgctactgctttgtggcacgcagaagccgtagggaacatggttcgctatggcattgcgatgtatggattgaatccttcaggaacggcattgccagaaacatatccattgaaaccagccttgtctcttgtttctgaattggtccaagtgaaattacttgaaaaaggagccggaattggctatggtgaaacatatatcacgccgcaagcagaatggatcggtacggtaccgattggttatgcggacggctggttgcgaaaaatgcaaggattttctttattggtagctggtgagtattgtgaaatcgttggtcgtgtatgtatggatcagctgatgatccgtttaccccggtcatttcctgcgggaacaaaagtcacattgatcggcgaagataacggacagtgcatcactatgcaaaaggtagcggaacaattagagacgattcattatgaagtggcatgcacgctttctgcaagggtgccgcgagaatataaaagttagggtggtcctatggtaaaaaggggagacatttattttgccgatctgtcaccggtcgttggatcggagcaaggagggattcggccagtattagtgattcaaaatgatttaggcaatcattttagtccaacggtgatcattgccgcgatcacggctaaaatggctaagccaaaactgccgacccatattgggatctcagcgacttgtacagggattggtaaagattcagtgatcttgatggagcagattcggacaatcgacaaaagtcgactaaaggagaaggtttgtcatctagatgaatcaatcatgtgtgaagtcgatgcggcattaatgatcagtgtgggagtcgagacggcttattccacgtcgtcgattcattcatgatgctaggatatttgttattagcggcaacactgatactatttttattttatacttatcaacacttgcggcgctttttacgggaaactaaaaagaaacaagaagacgttgaaaaagggtattttttattgagccatacatatgaagatcaggaaaaagcaagttactatggtgtctttcagcaaggagaaaagacattgacattggagatgccattgcagctttacctgcacacaagcccaccgcaacgtggcgaattagtcgcgaaagatggcaaagtcattgaattcaatacgtgaatacaaaaaaactttccatcactatatgtgatacgtgaggaaagttttttgcattagcagggaaaattttagcagaaacgataaattaggaaaaagagcccagtgtctagaacaagatcgttcagtcttttatctttttttatattctgagatcagagtgttgcattcgtaattctactttcaacaagcctcggagatgagttgctttatacgcaaaattcagttatagtatgtagcgactattttgaaaagaggaagcaatgtgaaaccttcaatttatggattaaccaaagagtccttatctttgtggatgactgagcaagaagaaaagaaattccgcacgaatcaagtgtgggaatggttatatgagaaacgagtagcgacatttgaagaaatgaccaatttgcctaaatcattggtaactaagttaaatgaatcgtttgtgatcaatcctttgaaacaaatcgtcttacaagaagccagcgacggcacagtcaaatatttgttccagttacccgataatcatatgattgagaccgtcttaatgcgtcaggaatatggtatgtcagtctgtgtgacgacacaagtcggctgtaatatcggctgtacattttgtgcgagcggtctgctaaaaaaacaacgagacctaactgctggagaaattgtcgctcagatcatgctggtgcaacattatttcgatgaattgaatgctggagaacgtgtctcccatgtggtggtgatgggaatcggcgagccttttgacaattacgagaatgtcatgcagtttctgcagattatcaatgatccgaaaggactagcgattggtgcgcgccatatcactgtttcaaccagtggtttagctcataaaatcaaagagtttgctgaaaatggcttacaagtgaaccttgcgatttcactccatgctccaaataatgaagtacgaacttcgatgatgcggatcaaccgcagtttcccgattgaaaaactaatggaagctattgactactatttggaaaaaaccaatcggcgaatcacgtttgaatacatcatgctggatcatgtcaatgatcgaccagagcatgcgcggcaattggtcgaattgctcaagaataaacgcaagctttcttatgtgaacttgattccttacaaccctgtcagtgaacatgatcagtatgctcgcagtaagaaagaagatgttttagcattttatgacatcttgaagaaaaatggtatcaactgtgtgattcgtaaagaacatgggacggatatcgatgcagcttgcggtcagttgcgcagcaaacagatgaaaaagcaagtcactgcctagaaacaaataagtctgaccatgaaggcgggaaagtcgctcattgaacagacttttatcaaaaaacggtacaggagaccgttttttcaaaatcagaaaagtaggtgaacggcactctttgttgacagaccgctgaaaaaggccagctctgagacaaagacgggtgcggttcctgcttttgctgatttttttatttcagaaaagaactgttttggataacaacaaaggaaagcgatttctctggattttttcaaaattccgatactcatggcttgaaaaatcgtctatactataagaattgatagaaataaaaataacacacatgatgaaaggatgattccatggaatggatcaaattgattggtattttggtaattcttgtcggctttttgctgaaactcgacacgatcgccgttgttctgatcgcaggattagcaaccgcattagtttcggggatagattttactgatttcttatcaatgttaggaaaggcatttgtagacaatcgtctcgtgaccttattcctactcacactaccaatggtaggaatctcagaacgctttggattgaaacaacaggccgttgttttgattgaaaaaatcaaaggattgaccccaggcaagtttttaagtttgtatttgtttattcgagaactagcaggtttcttctcgattcggatccaaggacacacgcaatttattcgtccaatcgtaaacccaatggcgcaagccgcagcggagaacaagtatggcgaactagaagaagcagatcaggaaaaaatcaaagctcgggcggcagctaatgagaactacgggaacttttttgcccaaaatacgtttgtggcggcttcgggtgttttattgatcactggaacgttaaaatcattgggttatgacgtagccgccagtgcaattgcacaggcttcaatccctatcgcgctgatcgttttagtcattgctaccctttcaaatctggctttcgatcgcaaaatgtctaaaaatatggcgaaaaggaggaaaagtaaatggaagcaatcatcaataatattttagaattcttttatattttgatcggtctcttgtcaatcatgactgctgttcgagtctttaaagatgcgacccatccaacacgactgggtacagcaacattttggcttttacttggtatcgtttttgctttcggaaactttattccttacatcattgatgggatcatcattatttgtatgggcgtattgacgttcttcaagcaagttcgaattggtaaaatcgtggatgtcgatgaacaaaaagcagaacaagccgccgaaagaatcggcagtaagatttttatcccttgtatctcactagcagtcatcgcagttgcgatttcctacacacctttaggcggacaagttgggatcgggatcgcttctgttttggcgttgattttagcaatggtattgacctctgctaaaccaaaaacagtgctggatgattccgatcgtatgttccaacaagtcggtactgctggtatcttgccacaattactagcggctctaggcgtgatttttaatgctgctggtgttggagaagtgatctcccatggtatttcaggtgtagtacccgaaggcaatcgtttgattggtgtgattgcctattgtttaggcatggttttatttacaatgatcatgggaaatggctttgcggcatttactgtcattactgccggaatcggtgtcccattcgtaatcgctcaagggggagatcccgttgtagcaggagcactggcgatgactgccggtttttgcggaacattgttgacaccgatggcagccaatttcaatgcattacccgtcgcattactcgagatgaaaaattcgaatgcagtaatcaaaacccaagcaccgattgccgtgctgctaattgtgatccatatcggattgatgtacttttgggcattttagtggtaaaaaggaatagaaaggatgatcaatatgaaatgtttagtcacaggatttgatccatttggcggagaagaaatcaacccagcgttggaagctgttaaattattaccagaagaaatcaacggagcaaagatagttaaattagagattcctactgttttcggcaaatcagctgaagttgtacaaactaaaattgaagagatccaacctgatgttgttttgaatattggacaagcaggcggacgttttgctatttcacctgagcgagtggcgatcaatgtcgatgatgcacgtattccagacaacgaaggcaatcaaccagtagatgaagccatccagcctcaaggtcaacctgcttatttcagtcagttgccgatcaaagcaatggtagctgcgatgaaagaagccgggattcctgctgttgtttcaaatactgccggtacatttgtctgcaaccacatcatgtatcaagtacaatacatgatcgatacaaaatacccaacgcttaaagggggcttcattcatgtcccattcgttccggagcaagttgttgacaagcctggtcaaccggctatgagcttacaagatattgcgaaaggattggaagcggcaatcggtgcgattgtcgattatcaaggaaaagaagacatcaaagcaatcgggggcgccattcattaagcggcacgaacagattgtcaattaaaacgaattgatttaacgatagatagatcagacaactaggaatataacttgtaagaggataggttgcttgcgagaataggccgatgttgtctgatcttatttatttcaagtaacgagcaagtatgaagcgcggaaagtcatttattcgtctttttatcgatttattgatagaattcatctagtggaacacgcgaaatgcgaagggggcaaatcatgatcattactgaatttgatagagagaattatattttacgtgatcagctgatcgacttagccgttctaatttatccgtctacctatcaaaaagagcagcggacagcagaagaattactgcagccgaataaagttgtcattgcagctattgaaggagagcaattggtcggctttgtgagtgccttccaaaaaagcgacactatctggcagcaagagatcagcttagttgatccccgacatccagatgaacaaataggtgagcgtttgactgcctttttgcgagacgaagttgttgctgctggcggagaatggctagtttcttaagtcttctagttgaacattgcttgtcaaaacggacacagacagttatagtggccaagatgtttcttaaaactagtcaagagttggaacataagttgaaacaaatgatatccgaatgatcaaaaatgaaggtcgcaagaatcatcaagattagcgacaagacacggctgtaaagtgagtgtctttcattgattgttcggatatatgcttgttttttgtaacttatgacacaactctttttgttttttttaaaagaaaaaatagtctttaaaataaaaatgagaagaagatgaaagtagcatatttattagttttctagtaatatttagtagaaattcttcaaagttattgtcttttatcgtgttttttaatgctaaaaattgtaaaaaaagattgcttttttaataattattaattaaaatctaatctaacttcagaaaagagcgattattctgaaaattaaatcaattaaggagtagttcaggatgaaaaataaatgggcatatggattggttgctgtgtgcggcttagttttagcaggctgtaccacaggtggttcaaataattcaagcagcggatcagctgccagcagcgaaagcaatgcggaacaggtattcaatgttgtggttcaacaagaaatgccaagtgccgatttgtcccttgcgacagatacaatcagtttcagtgcgctaaataatgtatatgaggggttgtaccgcttagacgctgacagcaaaccgcagccagctggagcagcagaagaagcagaagtcagtgaagatggattgacttataagatcaaattgcgtgatgacgcaaaatggtcaaatggcgaacctgtaacagcagctgattatgtctatggttggcaacgaacagtcaagcctgagacggcttcagagtatgcctacttgtacgcaccagtaaaaaatgcggaagctatcacagccggagagaaagatccgtctgaattaggaatcaaagcagttggcgatcatgagttagagatcacattagaaaaggccactccttactttgactacttgctggcattcccatctttctttccgcaaagtcaagcggttgttgaagaacacggggatcaatatgcggcaacgagcgacaatgccgtttataatggaccttttgttcttaccggatttgatggaccaggaaccgataccgaatgggcatacgaaaagaatgatcagtattgggataaagatacagtgaaattagaaactatcaatgtgagtgttgttaaagaatcagcgactgcattgaacttgttccaagatggtcaagctgatgatgtcattcttacaggggaacttgcacagcaaatggccaatgatgaagcgtttgtctctcaaccagaagcaacgacctattattttgaagtcaatcaacgcgatgaaaaatcaccattccgcaatgaaaatttacgtaaagcaatttcgtatgccattgatcgtgacgctttagtgacatcgattttaggggacggctcaattgcttcgacaggtctagtaccagaaggcatgacctttagcccatccgacaatactgattttactaaatcagcaggcagtgttttagaatatgatgaggccaaagccaaagagcattgggaaaaagctaaagaagaattgggaatcgattctcttgaatttgatatcttagcctctgatacagattctacgaagaaaatcattgaatatgtacaagatacattgcaaaaaacattggatggtttaacagtaacgttaagccccgtaccattctctgttcgtttggatcgttccaacgctggagactttgatatgttgatgggtggttggggagctgactatgcagatgctagcagttttacagacttattcacgactggcaactcatataaccgtggtcaatggagcaatgaagagtatgatgccttgattaaatctgcaagtacgactaacgtcaatgacccagaaaagcgttgggaagatttagtcaatgcggaaaaactaatcatgagtgaacaaggagtaatcccagtttaccaaaaagcagaagctcatttacgtgcaccaaatgtaaaaggtgtcgttgctcatgcagcaggcgcacaatacgattacaagtggacatcgattgaataaccacttgaatgcctagcggctgggacagtaactggatacaagatgacgattatcgatgaatagctggaataacaggcataacaaaaatggagaagctgctgcttctccaaaatgccaagtgcttcactatttgtcacgtatggaaatcttctcttgaatacagtctcagccggcttttttttctaaagcagaaaggcagtcgacaaaagacacaaaacgataggttactaaattaaagagtattgattaataaaaagagcaaagaaagtagcagtaaaaaaattcctggccatagccaaaagccgtagctttgtttaccaacatcggagagtttaaggtaatcggttttatttttggaaaaagcttttttcattgaatattggaaatgatcaaagaacccagaggcaaagacccaaagaaaaccgccgatgatcaagaagaataaagcccaaagaaatagtgcatccgagatagttgacagggtcaattcctttttgaaaaacaaccagctaatggaaataagggtacatatgagggcgatcagcccactacttttttttatccgcataagttgactcctttttaatgattcgtactacttaatttacataattattgataagaagtcaaaatacctagggggaagacgcgtgaacggttttttgaaatatttattgaaacggatattctatatggtattgaccttatggttgattgccacgatcacatttttcttaatgcaatttttaccaggaacaccttataccaatgcagaaaaactgagtcccgaacagattgccttattgaatgaacaagcaggtttagataaaccgatgattactcaatatgggctgtatttgacgaatttagttaaaggcgactttgggatttcattccaattcaaaaatcaaccggtagcgaatctattatctggtcggattggtccttctttacaattggggctgcaggcaattatttttgggacttttttcggtatcattttagggacgatctccgctatgaaacaaaatacatggattgatacgacgtcaacgctagtagcgatcttgggacgttcgattccgaactttgtctttgccgttttgctgcaatacatttttgccatcaaattaggtgtcttgccaatcgccaaatgggaaacttttgcaagcacgattttgccaacgatcgcattagccatgtcgccactggcagactctgcccgctttattcgaaccgagatggtcgaggtgctccacagtgattacgttgagttggctcgtgccaaagggctgagccgctgggagatcgccttcaagcatggtttgcggaacagtttgatcccgctgcttaccttgttaggacctttagccgttggattgatgacgggttcattagttgttgagaatatttttgcgattccggggattggcgaacaattcgtaaaatcaatcatgacaaatgattatccaacaatcatggcagtcacgattttgtactctgccatgttagtatttgtgattttagtggtagatattttgtatggtatcgttgatccgcgtatccgtgtgtcagaagggagccgtggctaatggaagagaaaacaatcaatcaagtagctgccattgatgcagccaaatttcagccgttacaaaaaaataccaaagaagaacgagaagcaattgctgcgccatcgctgacctttttccaagattcatggcgccgtctgaagaaaaacaaagcagctgtattttcgatcgtactattgctgatcattattgcaatctcgattattacgatctttgtttctccccatgaccctactgcgcaaaacgtgaagttcacgaatctgcctcccaaaattcccggactcaatctcccaggattaaatgggtatgcaatggttggtggtgaattggttgataaatatgctgctgccaatgttccagaaggcacttactatctactaggaaccgacggactaggacgagatctgttgagccgtttatttgtcggaacgagaatctcgctattgattgcctttattgccgctttgctagatatcatctttggtgtgacctatggattgatttccggtttattagggggacgagtggataatatcatgcaacgtttcttagagatcctttctgggattccgaatctagtggtgatgattttgatgctggttgtcttcaaaccaggaatcttttcgatcgtagctgcgatggctatcaccaactggattccaatggctcggattgttcgcgcgcaaacaatgaaattaaaagatcaagagtttgtgctagctgctacgacattaggtgagagccgtatgaagattgcgatgaagcatatcttgccgaatatttcgagtgtgattattgtccaaatgatgttcagtatcccatcagcgattttcttcgaggcttttctaagctttatcggtttgggcttaaagccgccttcagcatcgctagggatgttactgagcgacgggtacaagacctttttattcttgccttaccaaatgtgggtgccggcggttacgttgtcggtcattatgatcggattcaacttacttgctgacggactccgtgatgccttcgatccgaaaatgaaagagtgattgctatggaaaaagtgttagaagtgaaaaatttagagatctcctttgatacctttgcagggaaagtccaagcgatccgcgatgtcagtttcgaactatacaaaggcgaaacactagcgatcgttggcgaatccggtagtgggaaatcagtaactacccgcagtatcatgggattattagctagtaacgccaatatagataatggagagatcctattcaatggaacggatattctcaagaaatctgagaaagaactacaaaagattcgcggaaaagaaattgcgatgatcttccaagatcccatgacttctctggacccgacgatgcccatcggcaaacaagtggccgaatctttgatgaaacataacaaacttagtaaaaaagaaggactccgacaagccttggatcttttgaatctggtagggattccgaatgctgagaagcgtttgaaaaattatccgcatcaattttcagggggacaacggcaacggatcgtcattgccatcgcattaatctgttatccacagatcctgattgctgatgagccgactacggcactggatgtaacgattcaagcccaaatccttgagttgttgaaagatatccaacaaaaaatcaattcatcgatcatttttattacccatgatttaggagtagtagcaaatgtggcagatcgggtagccgtcatgtatggcggcaaaatcgtagaggtgggaacagcagaagaaatattctataatccacagcatccttacacttgggggctgttaggttccatgcctaccttggaggggacgggggatcgtctgtatgcgattcctggctcaccaccagatttgttggatccgccgactggggatgctttttatcctagaaatgagtttgctttgcagatcgatgccgaacagcaacccccattctttgatgtttcaccgacccataaagcagctacgtggcttttagctccgcaagcacctaaggttacccctccggatgaaatcttgattcgttggaaaaaattccaagaaaaaactagacaggcatctgtataaaggaggagaacccattggagaaagtgttgcttgaagtaaagaacttaaaacaatattttaatgtcggtcgcaaagacgaagtcaaggctgtagatgatatctcctttcagatctatgaaggagaaacctttggactagtaggagaatccggtagtgggaagtcaacgactggtcgaacggtcattcgactgaatcatcccacggcaggagaaatcttgtttgatggacaagatgtcatgaaaatcaaaggcaaaaaagatttagctgatttccgtcgagaagtacaaatggttttccaagatccgtatgcatcattgaatcctcgaatgaaagttcgcgatatcattgctgaagggatcgatatcaacggattggcaaaaaacgaaaaggaacgcaaccagcgcgtagatgatttgttgaaaactgttggtttaaacccaagtcatggaactcgctatccccacgaattttccggaggacagcggcaacggattgggattgcccgagcactagcggtagatcccaagttcatcatctgtgatgaaccgatttcggctctggatgtttcgattcaggcccaaatcgtcaatttgctgcaagatttacagcaagaacataagctgacttatctattcattgcccatgacctatcaatggtcaaacatatcagcgatcgcatcggtgtgatgcataatggtaaacttttggaagtaggttctagtgatgaaatctatcattatggggtccatccgtacacagagagtctcttgtcggcgattccactgccagacccagatcatgaacgagaacggaagcgcatcaaatacgtcagcgaaccaacagatgacaagcctcgtgccatggaagaaatcgcagaggggcattttatttatgctacgaaggaagaagcggcacagtatcagaaaaaattggcacaaaaaaaggggtagacctgtttaggaggagatgaaactgagtgttttaaaagcatacaaatttcggatctatcctacagaggaacaaaagcagttctttatccaaacgtttggttgcgtacgcttcacctataatcaattgctaaaagcaaagatggaagaacttactacaaatgcagaaaaagaaaaactaacacctgcaaaattaaaaaaagagtatccttttttaaaagagaccgacagtttggcactggccaacgcccagcgcaatttggaacgggcttttcgcaactattttcaaaagcgagcaggctttcctaaactgaagacgaaaaagaatatttggcaatcgtatacgacaaacaatcaacaacatacgatctacttggtcgatgatcagttgaaattgcctaaattgaaatcattcgttgcagtcaagcgtcatcggccaatcaatggtcagattaaatcggcgacgatttctgcaagaaacaatactgaattttatatttcgattctttgcatcgaagaaattcagcccttgccgaagaaccaacgaaagattgccttggtttatcatccagaagtgttggtagaggccaatgcacagttaccctttatcagtaccaatgccatcaaatctcaacaaaggctggcccgtgcagaacgaaaactaaatgtgaaagcaaaagctgtcaaacgaaaaaaaatggtgcttagtcatgctcgtaattatcaaaaacaaaaaggaaaagtttctcagctatatcgagcgcatcgtgatcaaaaaaaagaatacatcgatcaagtaacctttcatctggtcaaacaatacgatacgatttttttggaacggctgatcgatgagacttgtagatctacagggaatttttcagtcagcgactggcatcagtttattcgtaaaatcacgtacaaagcagagtggtacggcaaagaagtccgatttatttctttgtcggccaaagagtgtcaaaaaatgacgcaaatgttgcgtgtaatcgaaagtgaaacgaactgggaggagcgccagggatcgcctaggggatagaaaaaatctttggatttttgtttctaggaattctgctcactaattatgattaaccagcgaagaggctgtgacgtcaggcaaaacaaaaaatacccaaacgatacacaaacccacagacgctggctttatgctcagctgaaagtgattcgtctatcgtttcggttcttgtttgcttgtgttgcagcctctttgcacggcctacattttgtcgccaagcacatcagcattcaattcatagattttcgaaggtcgtccaataccgacgggcttttcaccgatttccgtgaaatattgaagcatggcttttttgaaatttgaatggtcaatcaatttaaaatcgatccccaaaaatttagcgaagactttacgtgcttcagtgatcgtgaagttttcgccgagaaccagcagtacttgtggttcgtgttccattttgtttgccactcgttcaaatgctttcaaaataatcgcgctatggtcaaaagccaatgtatccttaccgacagattgtcccgagactaggtccaagataatctcaacatcgccactagataaaaagatttggttcgcctttctctctaatgaaaaccagcggacttgattggcatcatccccagcgctcaaaggttcttcgccgataaaagcgagataactgaccgtaatgacccagccccgcgggtctcgccctggtgtgctgaaggtatggagttgttcgatgttttgctttgagatggttacgccgatctcttcttgcgtctcgcgaatgacactttgaccagttgactcattcggattgacgaaaccacccggtaaagcccaagaatttcgaaagggatgcccttttcgctgaatcagtgcaatcttcagttcttcttcttctttgttgtaacacatcaagaccatatcgactgtcacagaaggcttctcatattttggctggtcctgactgcgataccaagttaaaaattctgcttcagaagcttctttttcataatactctttttctgctgtttttgaggtgaattctttcattcctgtctcctactcctgatatgatgaaataataatgatgatggattagttaaaaaaatagggaaaaatcaaattgataaaaaagagtgctaaatagaagaatgccgctttttgtgtgtgcttcatggctaaatatccccacacagcgatccatagcaggaacccataacgaagcaatgatgtgatgaccacaaagaagctagctagattttgcccattgaaatagccgtaaaaatacaaataaaaactagaaaaaatcaaatggatgatcgttaaaacagctaagatcatgaagcgctgttgttgttttttcaagcgaaaaaccctctctttcaaacgttcattcctattatagcaaaaaaacagctcataaaccaaaaggagctgatagtaaaatcatctcatcaatttgggcaaaagaaaaaaggaaaaactcacagaaaattatggtatactaccttagtatacactttacaggtgaaaaggaggacgtacgcccatggctgaaaaagaaacattttatattacgacgccaatctattatccaagcggcaaattgcatatcggaaattcttatacaacgatagcttgcgacgcagtagcacgttataaacgtctaatgggctttgatgtgttttatttgactggtgttgatgaacacgggcaaaaaatcgaaaaaaaagcggaagaactaggtgttgatccacaagaatatgtagataaaatggctgccgatgtcaaaaaattgtggaaaacattggacatcagctacgataaatttatccggacaacggacgactatcacaaaaaggcagtccaaaaaatctttcaacaattattggaccaaggagatatttatcttggcgagtatgaaggctggtactctgtctctgatgaagaatacttcacagaaacgcaattggcagaagtttatcgtgatgaagaaggacatgtgatcggtgggaaagcaccaagcggccacgaagtagaattagtaaaagagtcttcgtacttcttccgcatgagcaagtatgcagatcgtctggtgcaatattatgatgagcacccagaatttatccaacctgaatcccgtaagaatgaaatgatcaataatttcatcaagccaggtttagaagatttagctgtctccagaacaactttcaagtgggggattccagtaacggcgagtcctgaacatgtggtctatgtttggatcgatgctttatcaaactatattacagcactaggctatggttccgatgacgattcattgttccaaaaatactggccggcagatgttcatatggttgggaaagaaatcgttcgtttccatacgatctattggccaatcatgctgatggcattagatttgccattgcctaaaaaaatcttcggtcatggttggctgatgatgaaagacggcaaaatgtcgaaatctaaaggcaatgtcgtttatccagagatgcttgttgagcgctatagcttggatgctttgcgctactacttgctgcgggcagtgccttttggcagtgacggcgtttttacaccagaagactttgtttctcgggtaaactatgatctagccaatgacctgggtaatctattaaaccgcactatcgctatgatcaataagtattgtgaaggaatcgttcctaaatatgcctcaaaagtaactccttacgatagtgagttgtcgacaaccgcagccaacgtcgtaggtcgctaccatgaagcaatggacaagatggaattcagtactgcattgtcggaagtatggacgttgatctctcgtgccaacaaatacatcgatgaaacacaaccgtgggtattggccaaagatcctgagaaaaaagcagaattagacagtgtgatggtccatcttgcagaaagcttgcgaatcgtagcaatcttgctgcaaccgatcatgaccgaaacaccggcaaatattttccatcagttaggcttaacttcagaagccatggacttgaaagacttgcggttcggtgaatttcctagtgataccaaagtagtggctaaaggaacgccaatcttccctcgtttggaattagagacggaagtcgcttacatccagaagaaaatggcggaaggaacgcaaagcactgctgaaacagtcaaatggaacccagaagaaacggttcttgcttctgaaaaaacagagatcaaatacgatgatttcgacaagatcgaattgaaagtagctgaagtgatcgactgtcaaaaagtcaaaggagcagataaactgcttcaatttcgcttagctgcgggtgatgatcaagatcgacaaatcttgtcaggaatcgctgagttttatccagagccgcaagatttgattggtaagaaagtcgtaatcgtagcgaatctgaaaccacgtaagatgcgggggcaaatcagtcaagggatgatcctttccgcggaagataccgaaggacgattaaaaattgttgaagctccaaagggaatgcctaacggatcaatcattgcctaagcgagacagtatttaatcatttctgttcttttttcagaaaatgaaattgcaactgaatgaaacattttgtataatggtctttattgagatgatcatgagggagtaactggcagcttatcgttgcggcaacatcaccatcctgaaagaaatttctggtgttgccttaaatagtgagactcgtgtatgtgttttagtgcatacatgagtctattttttttcatttcatgtacaataaagaaggaagaagaataaaggaggaaaaacatgtctgaagagaataaaaaagagcaactctcgcaagctttttatgcacaagaagctgaggctgttctgaaagagctgcaaaccgatgccaacggtttgacaaatgacgaagccaaaagtcgtctgtcacaatatggcgccaatgaattagaagaaggtaagaaaaaatcgatggctcaaaaattctttgaacaattcaaagatttgatgatcatcgtcttgttagccgctgcgatcatttctgctgtcgtgtcacatgaaatcgtcgattcaatcattattttagccgttgttattatcaatgcgatcatgggcgtggttcaagaagcgaaggccgaacaagccatcgaagcgttgcgggaaatgtcgacgcccaatgccaatgtgttacgaaatgggcatacggtgacgatcaaaagcgatgaactggttcccggagatatcgttcttttagaagccggcgatgtggtaccagctgatttacgcttattagaagctagttctctgaaaatcgaagaagcggcattaactggtgaatcggtacccgtagaaaaagaattgactgtgatcgatgcaacagatgttgggatcggtgatcgtgtcaatatggcttactccaacagtaatgtgacttatggacggggaaaaggggtcgttgtcaatacagggatggcgacagaagtcggtaagatcgctggtatgttagcaagagccgaagaaacggaaacgccgttgaaacgtaacttgaatgaacttggtaaattcttgacgatcgccatcatcgtgatcgccgtaattatgttctttgttggtacgatcttcaataatacttcttgggtcgacatgttgctgacatcaatctctcttgcggttgctgcgattccagaaggattgccagcgatcgtaacgatcatcttagcactaggcacgcaagtcatggccaaacgaaacgctgttattcgtaaattaccggcagtagaaacattgggtgcgacagacatcatcgcatcagataaaacaggtacattgacactaaaccaaatgacagttgaaaaactttatgtcaatgacaagcaacatgctgcttctgaagacattccattggatacaatggctctgaaagtcatgaacttcgcgaatgatactaagttcggtgaggaaggcaacttgattggtgatcctactgaaacagcacttgttcaattcgggatggatcaaggcttccacgtgaaagatcaagtgagtgcagaacctcgtgtagcggatctgccatttgattcggatcgtaaattgatgagtacgatccatgaacaagaagatggtcgttacttagttgcagtgaaaggcgcgccagatgtcttattgggacgtgcgtcaaaagtcttgttgaacggacaagaagtaccaatgactgaagaagaaaaacaaaaaatcttgttcaacaatacagatatggccaaacaagcgcttcgtgtcttgggaatggcatacaagtatgtagatgcagtaccagaaaacttggaatcagaaatcgtagaaaatgatctagtctttgctggtcttgtagggatgatcgaccctgaacgggctgaagcagccgatgctgtgcgagtagctaaagaagctggtattcgtccaatcatgatcacaggagaccaccgagacacagcagaagcaatcgctggacgtctaggaatcatcaagcctggtgatgacgcagctgtattgacgggtgctgaattgaacaaaatgagtgatgaagagtttgcacaaaaagtgactcattactcggtttatgcacgggtttcacctgaacataaagttcggatcgtgaaagcatggcaacatgaaggcaaagtcgtcgctatgacaggtgatggtgtcaatgatgcgccagcactgaaacaagctgatatcggtgttggtatgggaatcactgggactgaagtatctaagggtgcttcggatatggttctggctgatgacaacttcgcaacgatcgttgttgctgttgaagaaggacgcaaagttttctcaaacatccaaaaagcgatccaatatttgttagcggctaacttaggtgaagttttgacattgttcttagctaccttatggggctgggatacactgttgccgatccatctgttgtggatcaaccttgtaacagatactttccctgcaatcgcattgggaatggagccagctgaaaaagatttgatgaagcatgcccctcgtggccggaattcgaacttcttctctggtggagtcatgagcagtatcatctatcaagggatcttggaagctgcaacggtattgttcgtctattggtcagcaattcaatggccggtacacgatacctatgatgcaatccatgcggatgcattgacaatggcgtttgctacactaggattgatgcaactgttccatgcctttaacgttaagtctgtttaccaatcattattcaaagtgggacctttccgtaacaaaacctttaactgggcaatcttgctttcctttgcattgatgatggtcatcattgttgttcctggattaaatgacatcttccgagtggctcatttagatctctatcaatggggaatcgttctaggtgcatccttcgcgatcatcccgatcgttgagatcgttaaagctgtccaacgtgcaatgggcaaaaaataagcagtctctaaatttattccgcaggcagagtattctgactgcggtttttgttcacaccaatcgtcgtaaatgaataataggggcgaatgaacaatctgcttttgccgaccttttcatttttggcaataaacggtaaaataaaagatagctaagaagaaagtaggggaatgaatcgtgcgaccgaatttaggtttttatgtacaaacaatcaatgatctagtgaaagagacagagaaaatcggggaaaccatgaatccgaattatgaagagattcgtcaggctctcgataaaaaaaaggaatctgaactatcaccagagcgtctggaaacaatcgaagcgtcctttaaaaaaggaacggacaaatatcgtttgatgctggaacagatctctaaattacgcccgcctgcaacggtcatggggattcacaaaaaatttgaacgagcatatacgaagtatgttgctggctgtgaagaaatgattctaagtattgctgatggggtcgatcgggaagctttcgatgcgtcagagaaaaaacaagacgaagccactgatgaaatctcttttgcaattcagcggatgacagctctcttgttaaaaaaatgataaagttcgtttcttaaacgagagttatttaatttaaatgttatgttattcttatgtaaaatgatgatggtggatgtataatgaattaacaaccaacaacctttttatttttcattttactccttttgccatcaggactaaccaacttgatggtttttttatttttataaatgtttttttactcaaaataataaaatgactgcaaaagacattgtgaataaatttacctaacagtttgttagtatcgtttcactgctaatctaaaaacaagtatcgccaattgcggtttttcgcggtagatgctatactgaaaacaacttataaacgaaatgagggatcctccattgaaaaactaaccaatttgttggaagctgcatagaatcatgttctctagggagcagtgtgcagattttcaggattggtgtgtttttctggagggtctttttgtgtacttttctggaacctgacctgaaaataggcgcggtttttgtctagagatagacaggaggtacaaaaatgtcaaatataaaaatagaacaattaagttttggcttcgatactcagaatcatctgctgttcgatcaagctgatttggtgatcgatacccagtggaaattaggtttgatcggtcgaaatggtcgggggaaaactactttactcaaattactgcaagaccaattgccttatagcgggactatcacccatcagcaagcattcgtttactttcctcaaccagtggcagatccgcaacaactaacctatgatacattacaagatctgtgtgaatttgagcaatggcagatcgagcgagagttaaatttgcttcagttggatccagatgtcctctggcgtccatttgagacattgtctggtggggaacaaaccaaagttttacttgcactactgttcatcgatgaggaacactttccgttgatcgatgaacccaccaatcatttagacattacagctcgtgctcatgtagctgcttatctaaaacggaaaaaaggctttatcgtcgtcagccatgatcgacactttgttgacgaagtggtggatcacattttatcgattgaaaaaagccgactagtgatttatcaggggaacttttctgtttacgaagaacaaaagcaacggcaagatcagtttgaacaggagcaaaatgttaaactgaaaaaagagatcggccgtttaaagcaaacggctgccgaaaaagcagaatggtcacgaggacgggaacgagataaactgggatcaccaacaaaaaaaggcagtggagcagtctatgacacaggggcgattggtgctcgggcagccagaacgatgaaacgatccaaagcaatcgtcaagcggatggaagatcaagcacaagtcaaagaacagttgttgaaagacatcgaatatatcgatcccctttctatgaatgttaaagccacgcatcacaaagttttgctgcgagtggaaaatttgcaattgacgtatgagcaaccgttgtttgatccgttgaattttaccatcgaagctggtgaccggattggtattttgggtgcaaatggttctggcaaatcgagtttggtggctggcctattaggtcattttactggaactgtcaccggctctgtttggatgccgcaacatttgtccatcagtcgtgttcgccaaaattacgaggataatcgaggcaccttgactgagtttgctgaattccaccgattggattatcaagaattgttgaataatctgaagaaattgggcgtggagcgaaatgtctttcagacccgaatcgaagatatgagtatggggcagcgtaagcgtgtggaattggcaaaatcgttggcaacccctgctgagctgtttatctgggatgaacccttgaattatctggatgtctttaatcagaatcagttagctgaagtgatccaacttgtccaaccgacgatgttgatcattgaacatgatcgccattttctggatcaagtgactacacaacaatttttgcttggacatacagatctagcgcgtccataaatcgaaccgggataggatttttttaaatcttatcccgattttgttattttaaagtggtaggtttttgagaaagataccctattttgatcgttagtctgtttttttgatttgagtggtctagataaaaaataataaatggggtgcctgttttttctttttttatttattttagctggattttttatttattttgcaagaaaaaaagccttactgtgcaatattctgtcgttcaacaatctcatttttttctcatcgttctgctagttaattaaaatttctatcataattaccaaagggttttacaaaagatttacaataacagtaccgaataaaaatattcatttgttatcataaaaatcgaatttctttgagcgtttgacaacagcctgtaagaattcagctgtttttgtgttcctatcttgctggtcgaacaaaagcggcaaagagaaaaataatggaggttctttttttgatagaagtagttgggttgaagaaggtctttgacaacaagtttgaagctttgaaagcggtggattttacgatcgagaagggcgatcttgtttgtttacttgggcctagtggctgtgggaagtcaacgattttgaatttgatcgctggattgttgagtccgacagatggggatatccgctttaacggaaattccgtggtgaaaacggagccaaaggatcgcaatatcggctttgtctttcaaaattatgccttgtatcctcatatgaccgttttagaaaatgtcatgtttccactgactgttggtgataaaaaaatcaagaaaaacgaagcgcagcaaattgctgaaaaatatatgcagctgaccaatattgaagaattgaaggataaaaaacctggtacattgtctggtgggcagcaacagcgggttgccatcactcgtgcattagtccaaaatcctgaagtactattgctggatgaaccattgagtaatttagatgcgcgtttgcgtttaaagattcgcgaggagattcgtcgcttagtcaaagaagttgggatcacgacgatttttgtgactcatgaccaagaagaagcgttgtctatcagtgacaaaatcattttgatgaatgaaggcgtgatccagcaaaatgatgatccgcaaaatctttatttagaacccaataatttattcgttgcaaagtttatcggaaacccaattatcaatatcttgccagtagaagtgacagatggtgtcatgcatcatccagaattcacgatccctacagagcgcttcgtggatatccgcttcaagaaaccgttgacagatggtcattatactttagggatccgtccagaagatgtgttaacgacgacccaaacaccattattcaataccgagataaaaagtgttgaactaattggtcgtgaacggatcttgaactttgatctggctgacatccacgttaaatcgatcgttagcatcgaagaaatcattgaagaaggagcacacttagcttttgacttcaattacaaaaaagcgttcatctttgatgaaaaaggggagcgagtttattgatgttcaagaaaaattataatcccgaaaatcaacccaaagcttggctgttcttattgccctcactagtcattattttgctctttagtgtgtatccattatttcgttcattgtttatgagttttcaaaaaggatcattgatcaatcagcgatatgccggattagaaaactaccaaaaagtgctgacggatccagtgtttttcaaggcgctaaagaatacagcttggtttgcattcgccgtggttcctattgcattagtgatttcactagcgatcgcttggatcatctttgaaaaggtgaaacataagagcttttttgagacgatcttctttatgccgtatgtcaccagtaccatcgccattgggatcgtgtttcgctatttctttaatgggtcttatgggatcatcaactacttgctgggcttagtggggattcccgccgtcaattggctggataatgtcaatatgagtatgccgacactgatcatttttgggatttggagcagtttggccttcaatattattattctcttagcagggatgcgtaacattgacaaagaacattataagatcgcaaaaatgtttggcgccaataactgggagatttttcgcaagattacttttccgcagttgattccgacatttgccttcttgttgaccgttaatatcatcagtgcctttaaagtctatacacaagtctatgccttgtttggtggtcaacccggtatcgccaaaagcgcaaccacagctgtctattatatttatgacaaattccatattgcgggccgtcctgggatcgcaatggctgcgactgtgattctctttgttattattttggcggtgacctttatccaaaataaaattttaaagaaagtaggggaataagatgaaaaaagtcgtaaccctcatctctctgatttttttggcgctcttagcgatcatcacgatttttccgtttatttatatgattctcgcgggactgatgacttatagtgaggccaccagtattccgcctacgattttgccggagtcctttcaatggagcaactatgccgaagtctttaccaaagcaccatttctccgttactttctgaatacagtctttgtttcagcagtcacgactatcgccacattgattactgctattctggcagcttttgcattgactagtttggaattcaaattcaaagggcttgtgattgctctaatgatttccttattgatggttccttatgaatcaatcatctttaccaactacaacacgattgctcaaatggggttgttgaatacttacagtgcgttgattattccctttctgacgagtatcttttatatttattacctgaatggctatttgaaaagcatttcgaataccttttataaagcagcaaaaatcgatggtgcaagcgatatggcttacatacggcggatattgatcccaatgtctaaaccggcactagtgactgttggcatcttgacctttatctcgagctggaattctttcttgtggccattgttagtcacgaatgaaaaaaaatatcggttgttgaacaatgggctagcggccttcacatcagaaagcggtagcgatgttcatttgcagatggcagctgcgacattgactgtcattccgattttgatcatttatttgatttttagaaaagagattattaaaggagtggcaaaagatggcatcaaaggctaaaacaacagttacatttcacagtggtattctcacgatcggcggcaccgtcatcgaagtgacatacaaagatgcccatattttcttcgattttggttcggagtatcacccagagcagccattacccgacgaagcattacagaccttagtggatcatcgctgggtcccgcaattgcgcaatgtctatgatcctcgtctgtcttatacgtatcatggatcagaacaaaaggactatcaagaaacagctgtttttctatctcatgcccatcttgatcattcaaagatggtcaattatttggaccctgcaatccctttgtataccttgaaagaaaccaaagcgatcctaaaagcattgaatcgcaccggtgattttttgattcctactcctcatgaagcccctgcctttgtgcgggaaatgattggcttggaaccccacgatgtgatcaaagttggtgagatcgaagtagagatcgttcctgtggaccacgacgcctatggtgccgcggcattgctgattcgaacaccggatcactttattgcctatacgggcgatttgcggttgcatggctatcatccagagcggacaaaagaattttgtcagttagccaaacacacggatctattgatgatggaaggagtcagtatcagttttcctgaaagagaaagcgatccagatactatcgaagtagccagtgagaaagaattggtagcggcttttgtcgagttggtcgaaaaaaatccacaacggcaaatcactttcaacggctatcctgccaatgtagagcgttttttagctttggtggatgcttgtcctcgaacgatcgtccttgaagcacaccaagcagcattactgaaagaaatctttgacagagaagttccctattacacggttgaaggcggagcttccttagcagagttagatcctgcgctagaaattgattatcgttctttatgtgtcgacactggccagtatgtctggcaagcagttgaccattttgaaaatttacaaccaggcagtctgtatatccatagcgatgcacaacctttgggggcttttgatcctgcctatgaagagtttctcgctttgttagcaaagctggaaattgagtttgtacggctgccggtttcgggacacgcagttcctgaggatcttgatcagattattgcgtggatcgaaccaaaaagattggttccaatccataccttgaaaccagagaaactggtgaatccgtatggcgaaagaatattgccagaacgtggcgagaaaatagaactataaaaggatagaggagagtaaagaatgaaatcaaaaaaactagcatttgcagcagtggctgcggcaactttagtgttaggggcatgcggcaacaatggctcaaatgacagtgcaaaaggcagcgatgagatcgttacagaggttccgaaagatactactgtcacattttggcatgcaatgaatggtgcacaagaagaagcactgacgaaactgacagatgagtttatggaagcaaacccaaatgtgaaagtagaactgcaaaatcaatctcagtactccgatttgcaggcgaaaatcaattcgacactaccttcaccaaaagatttgccaaccatcacacaagcgtatccaggttggctttggaatgcagctcaagatgaaatgcttgttgatttaggcgagtatatcgataatgatacgattggttggggtgaccaagaagaaattcgctcttcattattagaaggtgcacaaattgatggtgtccaatatggtattcctttcaacaaatcaacggaaatgttattctacaatgcagatcttttaaaagaatatggtgtagaagtaccgacaacattagatgagttaaaagaagcttcaaaaacaatttacgaaaaatcaaatggcagcgttgttggtgctggctttgattcattgaataactactatgctattggcatgaaaaacaaaggtgttgattttaacaaggatttacagctagacagcgatgaatcgaaagaagtcatcaattattatgcggaaggtgtgaaagacggctacttccgtattgctggatccgatcaatatctttcaggaccattcgcaaacgaacaagttgcgatgttcatcggctcgattgctggagaaggatatgtcaaaaaagacaccgaaggcaaatttgaatatggtgtctctgcccgcccagaaaaaatcaatctacaacaaggaacagacttatatatgttcacaagtgcatctccagaggaacgtaccgctgcttttgaatacatgaagtttttgacttctcctgagtcacaattagaatgggcagtttcaacaggatacatgccagttgttcaatctgttttagatagtgatgaatacaagaacaatccagatacgaaagttgcttctgagttaagtgaagcaacaaaagaacttttctcgatcccagtaattgaaaatgcagactcagcttacaatgaagttcgttccatcatggagaatattttgtcgaatactgacaaagataccgataacttgattaaagattccattccacaacttgaggatgtttggaatcaatagttctgctcgtaaaagggccagacaatgaccctatcaacccgaaagagaccgtcagatatccctgcggtctcttttacataaatgttagaggagtaatgagaaaatgcaaatcacctttcttgaaaccagcgacatgcacggctatgtctacccaactaatttcgccgacgaccacgatctggctattggggcagcgaaagtcgcaacgaaactaaagcagttaaaagccgaagctgatggtcctgttgtaatgatcgaaaatggcgattttatccaaggatccccactgagttattatattgccaaaagccagcatccggtagcagaattgaccaaagtgatcaatcacatggcatacgatgtccatgttttaggaaaccatgaatttaattatggattaacgtatcttcaagaggcaatcgctagttatcagtcccctgttttagcagcgaacatcttaaatgaagagggacagccctatttcggcaaagcctatacgatccttgaaaaagatgggattaagattgcggtgttgggattggtgacccagtatattcctcattgggaacaaccagctaccatcaaggggatgcggttcgaaagcattatccaaacggcaaaaaaatatgtgcctgagctaagaaaacaagcagatcttgtcatcgtcagctatcatggcggttttgagaaagatttggtaaccggtgaagccaccgaattgttgaccggagagaatgaaggctatgagttactgcaagaggtgccggggattgacgctttctttactggacaccaacatcgggaaatcgccgccattgtcaatggggtccctgtggtccagccaggttatcggggcagccaaatcggccgaatccaattaacaatagagaaaaaagagggtcaaacagtgattacggatcaacaagcgacattgcattcagtggcagaagtttcagccgatgaagcaattttggcaatgatcgaaccaattgagacggaattggaaagctggttggatcagccgctagggaaagtgaacggggatatgcgaattactgatccgatgcaggcacggatcgtggaacatccatacgtggaatttatcaatcgcgttcagatggctgccagcggagcggaaatatctgggacagcgctcttcaataatgaaggaaaaggcttcggtacaacgatcacgatgcgggatgtcatcacgaattatatttatcctaatacattggctgtcgtaaaagtgaccggagcagagttgcgtcttgcgttggaacagacagcgaattacttagccgtcgaagcagggaaaatcgtctttaatccagcctttatcgagccgaaaccgcaatactacaattatgatatgtacgaaggaatcgactatacgattgatatgaaccagccagttggcaaacgaatcacacgcttgttgttccataatgagcctatcacgccggaacaggagctggaagttgtcgtaaatcaataccgagcggtaggcggtgggaattacgcgatgtttacagccgacaaaattgtacgggagatccaagtggatatgactgaattgattgctgattatttgaaacaacacccagtactagaagctgagacgaatcagaatttcaaaatcgtgtactaaaaagccaaaaagggctgtgacataagtcatgcaacaaacgaacgattccgaggagaatgagactgtgcttgcgcttcagcaagtttccatcaccaatgtacgatggatgacacccagttatcctcggatcgtcttgtctagttgctacttatgacacagaccctttctatgttcttgtaaaagaaaatcagattagttttctacattgcggacatattcatcgaagtaacgaatcaaatcggcttttacctgctgatagtcttcttcgctatagtttttttcctctaattttgcttggaaaaaaggaagttctaactcttcttttaagcgctcaagcacttcttcttggttcatgagatcaccttttcgtctatttggtaccatcataacaaattgaatgcggctgtcaatgcttcatacatttctttcattttttccaaacgacttttaagagaaacaaagtcatcgtcatcatggaaaaggacttgtttcaattcaaaatagtaaatctcaaaagcatcaaagaagccagtaacttcggatgtttgcaattctttaaaggtatcacaacgaatataggctttttctgcaatggcataggtttcagccgtagtcaataagacgagggcttcattgtaacgacggctagtgaccaattcataagttgactggcacttattataaatatttgaaaaatctttcagtaaaagctcgatgggtgttttatcaaacatgggggagtcctcctgatcgttttatttttcaaataagacacaaacacattcaggcgcgtaaacgtctttttgaatagtagtgagttcaccagtttcggcgttgcgacggtacaaagtcaagttgtcggaattttgattggcacaaactaagaatttgttggttgggtccaagtcaaagtctcgcgggaagtcaccttctgttgatagacgttgaatgaaattcaagccagcgccatcttcagttacttcaaagacaacgagagagttgtgtccacgattggatgaataaacgaaacgtccatcttttgatactcggacagcagccccactattaaagtcggtgaaatcttctggtaaagtcggtactttttggatttcttcaaagctgccatcagcttcattgtagcgtaaaacagtcaaagagctgtctagttctcctaccagataagcatattggtggttaggatggaacactaaatgacgagggcctgttccggcagctgcaacataaacagccgcttctgttaattttccttcagcagaaacgtcatacgtatacacacggtctgttccaagatcacatacagctaagcgttgatccggcgttaagtctgtgtagtgtacatgagggttgtcttgattttcgtgaggaccaacaggttcatcatgatagatgtgatcagtggcttcaatactgccgtccgccaatattttgtagacgtttacttcacctttatgataattagcaccataaacaagttgacgaggttcatctactgctacataacacaatggtgcgccttcttcggtcacagtattcaacaactcaaatgcaggcgtataagcaccacaaccgcctgcgccatcaacttcggtcacagtatatactctttcttttttactgcgggcaagatacgttgggctcttttcttccgcacgcaaggtcaagtcgaccaattgttctttttctgtatctaaagtgatcgaatagatccctttactttcgcgacgcgtataagtgcctaggtagatcgtttgcaacataaaaaaagcctcctaatagtttgatttcttattaattctaccatagaatgcggaaatgggcggatagaaaaacttcttatgttataataaaaaaagaacataaaggggaggttgttgtatgaaacaaggaacaatcaaagcgattgggccacaagcgatcgatcaaaaagaaaaaatgctgatttttttcggcgaccaagcaacagagatcttaagggagtattcagtgatccaatcgattccagattctcaagatttggtcgtagaaaacggcgatacacttatttttggggatcagtcgtacaccgtgacacatgtcggtcctatcgcaaatcaaattttgcaaacgatccagcatgtgacatttatcttcgatgaagtacccgaagagcaactgaccagcgctatctatttagaacctttcaatttgccgacccttgaagttggtatgaaagttatctacaagtaggaggcggggaaatgaaggaaacagagaagcgccctttgtcctggttttggaagtggtttttaaataatcaagcagtcacgagtctattagtggttctactcgtcttattgatcttgtttatgtttacgaaagtatcctatctatttgagccaatttggcaatttctggcgattgttggattgccaatcattttggcggggattttgtattacttgatgaatcctgcggttgattatctggaacgaaagggaatcaaacgcatctatagtattttcggtctttttattttggtcatcggattgatcgtctggggcgttgtggtgattgtgccgaagatccaagaacagtccatgagtttcgttgagaatttgcccggatatttggatatcattgaaaataaagtcaatgagattttgtccgatccgattttctcacaagttcaagatcaattggaagcatctaatgagaagttgattgcatcaatgaccgacatcattcaaaacttatcacggagcacgattcaaaatatcggcagcttttttggggccgttgcaacggtggtattggctgtcataacgatgccctttattctcttttatcttttaaaagatggacgacagttagcaccttatttcgtgaaatttttgccgacaaaaatgcgtaaaccatcattgacggttttaaaagagatgaatgatcaagtttcttcttatattcgcgggcaactaacagtcgcatttgcagtagccatcatgtttatggtcggttttagtttgatcggcctagattatgccatcacattagggatcgcagctggctttttgaacttgattccatacctaggctcttttctagcgatggttccggcggtctttttgggtatcgtcggtggtcctgtcctgttggtgaaagtcctggtcgtctttgtgatcgaacagactattgaagggcgattgatctcaccactcgttttaggaaacgagttgtcgatccatcccgtgacgattttattagtattgctgacttcgggtaaactcttcggacttgtcggcgtgattctggggatcccggtatatgctgcggcaaaagtgatcattacccatatttttgaatggtatacgaccgtatcgagtttgtatgaagaagaaacggaaagcgatgttcagcaagaatagttcgaagaaaattttttgacgaaagatctttgtgaaaatcacactgactcacacatttttctagttttttatcggagtataaaaaagctgaatttagaaggctggagcgaattgcttcagcctttttgttatgtgcgatttttgacacatagttgcaagaaaaacatatagcttctgtttctagagaatgcttatactgaaagcacatacaagcaaaggagcgttggaatgaagattcttgcagtagatatcggagggacaatgatcaagacggggttgttgaatagtcacggagaaagaatacaattaggaagctttccgatgaataaagactattcaactgtgatcgaccgattgatttcacatattgataatgactatccaaaagacttttccggaattgctattagtacgacaggattagtagatccagtgacacaacagattgggatggattcaccgctttatgagggatttggtaatcgcatggtttcttttttaacggactattatcaaaaacccgtcatcgcggagaatgatggcaattgcgcgcttttagcagaaaaatggctgggaagaggaagaggcgctagcagttttgctgtcattgttttaggtacctctgtgggaggcggattgatggtcgataaccagttgattcgtggcaaacactttttagctggcgagtttggttatatgctgtttcctgaagtcgaaaagaaagattgggaaatttggagtattgccggtgcaacaagaacattggtagaacaagttgcagccgaaaaaaaaagccccctcgattgatgggtataaagttgttgcttactaccagcaaaacgatccggcagtgacgatttgggtggatcgctttattgaaaagctagccgtggcctgctacaacctacaatacattcttgatccagaaattgttttgattggaggcggaatcagtgaaagcgactttttactgccgctattagaaaagaagattcagcagattgcagcgcagattcctagtacagttcgattgccaaatgttgcctgttgccagtttgggaatgagtccaatttaattggtgcttgctacaattggttactgcaaacttttgaaatgaaaactagctaaaacagttgcaattctaagataaaaatgtaataaaaaaatagtctctatttttttattatgtaagcgtttaaattgcagcgaatgaaacaagggtcaggtgataaaagcgaaaaagttttacgatcaaaacgggcaaaacacgttcagagggatcgcgcgctcaatcagttcctacttgctggtattcctgatcccctttttaacggtctcgtggatttggtatgcgacttctgtcaaaagtatcaatgaacaggttgcattaacggcaaagaatcagttgattcaattgaaatactccttagagaacaacttccttcaattgaactacctgacccagaaaatgacggatgaccatcaactctcattaaattttttgacccatccctattattcaaaggaaggcaaagcaagcctgcaaacctacaagatcacgaatgagtttgtcgaagaagtttatttatactataaagaagaaccggagaactttttttcttcgattggcaaattatccgtcgaaggtttcttagaaaaagtaatcccagataatgatatgcagcaaggacagctgatcgatcagctagagaaagcttatccaacgttgctgactatcgaaggggcatcattggcacggcatcattcccgattcttctacattgtgccgttacaaaatgatgaactgactgtctatggagcagctatttatgagatcaaagaagctagcttagcaaaaatgctggacttgaccaatagtgatggtgcgagtacgaattatttgatcaatgatgagtttcagattttagctagcacaaatcataacaatttgacagtttttttgaatgatccccaagaaatggctcagatcaccactcaggacacctttcagtttaatcagcaaaagtacctcgttcaatcaattcccaatgaggaactgcatatctcagtggtatcggtgaccaatccatcacaagcattatcgctggtcaatcgcgttcaagaacatttcattcttatttttatgtgtattctattcgtggggatcattgctgttacattaatggggatcagaaattatcgaccgatccgcaaaatcgaacatttggttcgagaattccataaagatatggagatgtcggtcaattcgatggatgatgttcataatacattggctgctgttttagaagaacagcaggaactgcataaagaaatccagatgcagacgccgcatgctcgagaacaagttcttagaaagctgatgagcggtcgtctgcgttcggaacaagaagttgcaaggctgatcgaagccgttcatattcattttcctgcggacaattattttgtcatcacgatcgataccaaaaccgtggcttcaaaatataaagccggcgagagctgttttctgattgactatattgaagaaatcagcagccaagggtacacagcctacgccacagagatcctttccactgaagtgatcgcattgactgtgggatttgatcacagataccaacaggaagagatcgttcaagaagtcgcggcaaaaatagcagctgcgattggactgcttccagcaattggggtgggaaccatcgtcaatgaattgacggctatcaatgaatcttatattgaaggattagctgcattggattatcatgtcagtaacaaccagcaaatcatttattaccttgaaatttccgcagaagaacaacgctcggcgatccagtatcccgacagtcaaaaattaaaactgatccaagcattgaatcaaggaaatagcgatatcgcaattgaaacggtgcattggttaatcaaagacgggttaagtaaacaacgatctcagccggtccaaaagatgtatggctattatttattgaatacggttgcacaaactggaggcgaattagtgggagaggagattttgctatttgcagccgaacatgcagattttactaatctgatgcagctaggaacggtgttgcaacaattggtccagcatatttgcgaaaaagtgagggatcgaccacaaaatcaagaatcggagttgaatgaaacgatttttgcttatatcaaagcaaattttcagtcttctcagctgtcattggaatctattgcggaagaatttaaagtatctgtctcttatattagccgatttgtgaaaaaagaaagtggcaaaacattttctaagtatatccaagaactgcggttagaaaaaatcaaacaagaattagtcgaaaccgatctaccgatcaaagaaatcattcgggacaacggttattatgatgtctcgaactatacgcgtaagtttcgaacgatcgttggtgtaacaccaggacaatatcgcaaaatcaaccaaaaacgctgaaaatgcgaaaaatgaagggaaatgtgacaatgaaagaaatgactcaaaaagcgagagaactttatacttctattggtgtctcattagaagaggaaccaaaaattaagatcgaacctgcactaacggcagattttattcttgatgaggaacaaaaaacgatcactgcgaaagatccccagcaattattttatggtctgacaacctactatttgaatcaagtgacgaagaaacaacaaaaaaacagctacaccgcccaaatcaaggagcgctgcctaatgatcgatattggccgcaaatatttttccttaaaagaactaaaagcactcgttcacagtatggctttttttcagtttacccatttgcaagtccatttttcagaaaatgaaggatttcgaatcgagtctgaacgttttccggagattgtatcaaccgaacatttaacaaaaacagagatccgagaactaatcacatatgccaaaggttacggtatcgagatcattcctgattttgactcccctggacatctcaagcaagtcttagccacccatcccgaatggtgtttacctaacgcgactggtggggtcgatgctagggcattgaacattcttgaccaagaagctgttgctttcatccgagagatctacaaagaatacgcagagctatttgtagatagccattatttccatattggtgcagatgaatttgttgattttgaccgtctagaagagtttccgactttagttgaagctgccaaagaagcatatggaccagaagcaagtgggattgaagtattcattgcgtatgtgaatgatttggtggactatgtgactgacttaggttttgttgttcgtgtatggaatgatgggttttatcgcttgaatcgaaaggaacagctttccttaacgaaaaactgtgagatttcctattggacacgctggaatcaaaatatggcaccagtcgctctttattttgacaaaggctattctgtgatcaatcacaatgacaatttcttttattatgtagtaggtgaagctgcagggtatacgtatccgacctatgaaaaaataagcgatgagtttacattaacgacttttgccaacggacaacaagtgacccaagaacaactagcacaaaccccagcgatcgcattagcgatttgggcagatatcccagatgcaaaagaaggtgcggcagtgatcacagaagctttttggctgcaagctatcattagcctaaaagtttatgaagaaacagatccagggaaagaaacctttagccaactatttcagaaatggcagtcgttgttgactaaagagcagtaaagcgaaacgttctctaggaaaacgtgacttgttttaaagtggacgataagaagagattcctaagaagaatacatggagagaatacctaaagcgagtatttaaagcaagtacttaaatagtagacggcagtctagtgaatcttcgtcgtgggtttgcgaggaagatttactgtctgccgtctatttgctagagatattgtctagcgctttacggtattctttgttctactcttttcacttcaatgtaatctcaaggactggaatgagaacattaggtggcactaccggcagcgtgacgactagatcattaggagcaatgacagcttccgtagaagtgatgacttcattaggatcaaagccacgataaaaaatttcagagccatcatgcaagaagcggataaagcgaacttgatcagcaatttccggcaaatgaatatgtttgaagggatagctatatacatgcaaatagagtttcttgccattttgagtataacgacaatctttaggtaccgggtatttactaggaccacaatcgatgatagcttctttatgcagccgtatccatgcaccaatcgcctgcattcgtttgactgcccgcgggtcgatctctcctcggggattaggaccaatgttcaataaaaaattacccccttttgaaaccgtatcgatcaacattttcaccaacatatcacttgatttccattccaacgcatcgcgatcatagccccaagtcccgtacattgtctgacaggcttcccaaagaacaggtaaaccgtctttttccagtggtttttctggttgaaattgttcaggggtggtaattccccgaccaagttccaagcgatcattgatcagcatatccggttggagtgtccgacagattttttccagtcgcgaactgtcccagtcttctgctccttttcctttagaccagccccaatcacgatgactgtaaggaaagtcgaaccacatataatcgatcctgccatactgagtcaatagttcggtcacttgaccagcaatgaaatcttgataaataagcatatcccgttgagaattggactctcgagcggctaagtcacttctttgaggatgcaatccatcaatcgtaaaatgagggtggtaccagtcaatcagcgaatgatagagtccgattttgattcccacatcacgaaacgcaggcaataattctgcgagtaaatctcgcttaaagggtgtattggtgactttataatcggtccattcactatcccatagggcgaacccttcatgatgtttcgtagtaaagactatatattgaacaccgcaatctttagctgtttgggcccaaacagcagcatcaaataaattgggattaaattggtcgaaataagtttctcgataagtttcgggggcaatttcttcggtggtcataaaccattcgtggcgtgcaccaatactaaataagccaaaatgaatgaacaacccaaaccgatcatgaataaaccagctaggatcggggtaatgatcaggccaattctgaaatgttttcatagagatactccttaatcaatgaattcggtgtttgtcataaccgtttctttaatcttccactgcccattctcgagcacaaaggtatgatgggcttgggtaatatggtcgcgatagtcattctgtccttggttcactgttttttgctgtgcagctaccagcatggagtctgcttcttgtttgacaacttcaaaagacaagagttcatgagtcaaatcatatttcgcaaaaaaagcgtgcatttcctttgccgtagattctcttgcagaagtaacaagggtcgctgtgtagccctcaacgtctttctgggtggctgcctgcaggttttgctttagtacggtcagacacgcttgtgctgcagaagaatctgtaacggctcctgtaacttgcaaacgcgctacagtggtttctgctgaacgagaagttgtctgttgataaaaaaatagaccgcaaatgaaaagtaaaccaacgaaaaataagggataactcttttttttcatgcaaatcctccttgttttctgcactattttttgtactttttttgtacttatacatcagatatcttgctggcactataaatgccatggaaaagatttcttcccaaactgccgacacttgagggatcatctactggcaacagtggcatctctagttctggtaatctagtgatgtgaccatccaaatagttctgcaaacgccattgtgccatctcggcacgtttagatagagcgccgtagcgaagatcgatcacttcaaacccaaaggggcggttccattcaaaccacagatctctatgagattgatgcaagtgttgtaattcctgctgatagtgctgaatcatctcaagggctttttgaaggttctcacgttttttttcatgataggcttctgagatccagggactcaaagaagctttcaaagctagtaccaccgctaattggtgataaaagcggaacatccgttgtgtgtcctgtgtccccgtgactgcggccaatcgttgggccagttcctcataatgttgggtcaatggcacctctctgaatgtcttttcataaaggccataaagaatatcttgataaagcaataatttacttggatttgatccagaaggattttcggcagcaacaccgggagtttggtcaaaaagatccagcaaaagaaaatcttctgcttgtgatccatgaaatagtttcaagtgatctgtgactatctcccgcgatggcgtggcataaaactgggcttcgctaaataattgtagacctaacaagctggcaatcatcggggtctctgcgccgtcatctccccataaggtagcatagacttcagtgatgccatttgctttggcacttcttaatgcttgctccattgtagcgatggttttgccataattgggtgccagtccattccatgtccaaataccgccagcaaatactgtgggttggtttagctttttatgttcagcaaacagtcgttgatatgtttgaaaatcatgatgataataatcccagtacaccatgttgactgctggaatttgctgaatgacttctggaggaatgacgactgctggatcatagtaatcgcctgttggagaaccaatccgaaagaacatgtcactccacatcatgggttctaattgtagctgttcacagagagtgatgacgtgttttaaatgtttaatcatgatggcaaagcgatcttctaaaccattgtgttcgaggtaacggccttttcctaattggtgtgcttcatccataccaatatggattttatttgttttgaagcagctgcgaatggaacgaagagcggcttcaagaaaaatgtaagttttgggctcaccaactagcagaatgtcttccgtgtcacgtatctctttggcaaaatgccactttaatggatttgtcaaatgagcgagtgtttggatcgcaggaactaatgtaacgcctaattggtcagcgtaatggtccaattcccgcaagtcagattgactgtatctccctcgcaaatgaccaaaataaggatattcaggaatttcgtaagtatcttccatatatagcatgagactgttgagccccattttgctgctcaacaaaatgaaacgtttcaactgaggtactgtcagtactgcatttcgagataaatcgatcataggaccgatttggtcaaattgcggagtctcttcgtggacaaaatcggtatctgcttgcatccatagaaggagccctcgaaataaatgggctttttcctgatagtaaatcgtggctttttctgtattggaaatgattttcaatgatccttttcggcggatcaattcaagcggtttgccggtttctgatagtgacaagccaagttcaggagcaacgatttgaaaaaaagcggcgacgttttcgttggtgacaatctttatctccatgattcacttctcctttagtaaaaaatcgtcagtgttcatttgttagcaactctgttttttggatcgcttgataggcgaaccaactgattggccagagaagcaaagggatgaaggcaatgaataacaaaatcggcaaaaaggtagcggcgaatgtaaccaaaaacacacctaagatcatggcaatcgtttgtggcacactaacgatcattaaaagaaacgcattcctgaaatagacccaaaaaggaagatggtagcggacaaagaccggcagcaaataaaagctgatgagcaaaccgctgataaagagtaccgtcaatccgaaatggagaaaggcattttgcaagaatgtactggagatccgcagctcgatccatagcagcagcaagatcgccatttgcagcaaacctagttgattactacgccaaaaatttttggctgtctgttgtttgaaccaactataaagttcagcaggcagtggtttttttgcaaataattcaaagaaatagcgaataacagtagccgtcgctggaaagaagccaaaaatgattcccccccgtaagacaaaaaagaaccacaaaaaatgcaatcgaatcaccatcagcaaatagtcacccaaccggtaagatagatcaaataaccctcgtgattgtttcatggacacccctcttttaactaattgataaaaagtagaaaactactagccaaatagtagcaagaaatggaccttttagaaagcgtattcaaaaaattacatagccggaccagctaatacatacaccttcctaaagctatcttttgaaaacattcgattgcgacgaggagcgctagcccgcaggagcaagttttctagataaagagaaaagtacgacgaggagcgctagcccgcaggagcaagttttctagataaagagaaaagtacgacgaggagcgctagcccgcaggagcaagttttctagataaagagaaaagtacgacgaggagcgctagcccgcaggagcaagttttctagataaagagaaaagtacgacgaggagcgctagcccgcaggagcaagtcttctagataaagagaaaagtacaacgaggagcgctagcccgcagttttcttacaaatgagaaaggtgaaattgctagagtgaacatggcgtctgataccgtaagctaaaacttcaattgaagtggtgtgttttttaaaaagagtgctcttttgttacaaaaaaataaagtttgacatagctgctgaaactacatattgatagcgctttattttctcgttagattagtggcgaaaggggttggataaattgacaacaattcgtggggacattgagtctgcgaaaaacagtaagcaggatgatcgttggtaccctgagtcagagatgctggccaagcgtttggaatggttccaagatttaaaatttggggtaattttccattatggcttatacgcacaagcgggtatcgttgaatcatggcaactatcagaaaaagatgaatgggcaagggaaaataaagcttatcgagaagatatcaacacattgcgtcttgattattggcaactgatcaaagcgtttgcaccgatagaattagatactgatcagtgggctgaaacgtgtaaaaaagctggcttcaagtattgtttgttcacaacgaaacaccatgacggctttaatctcttcaatacgctggagtcagaattcaaaattggcggtaaattgagtccttttaaacgagatatcctaaaagaagtttttgcctcgttccagcaagcgggtattgctactggggcttattattctaaggcggactggtactcaccgttttattggctggatgatgaaacgatcaaagggcgtcacgcaagttatgatccattagaacagccagaaatctggtcgcggtatgtggattttgttcatcgacaaattcatgaaatcactggcaactatggaaaagtggatttgctatggctagatgccggctggtgtgggcaggggaaagaagatttacagatggatcgcttagcggagattgcccggcgaaaccagccagaattgatcattgttgatcgcatgatgggcggtagacatgagaattatgtgacgccagaacgcaagattccttctttagaagaaatcccaacaaaagtttgggagagtaatatacctataggcaatgactggggctatgttccccatgacacctttaaaagcagccaagagttagtcgatacattaatcgatgtcgtcagtaaaggcggaaacttaattttaggagtgggtccaacaccagaaggaactttcacgaaagaagagacccagcgcctgcttgaagtgggtgattggttggaacaatatggggaaggcatttacgagacccgagctagaccagaagcgtggacggagaattggcatcttacctatagcaaagatcaaaaaacacattatgcctttcgcagtatcacaacaaatttgcagccgcgaatttttctgaaggagatccatgcagatgaaaaatccgtgatcacagatttagcaaccaatcaatcactgacgattcatggaacgggtgaaaacgcctatattgcttcatcagaagtgcatcagcctgaacttggagcagttggcattcgcatttctacacattgaagaaaaaatacacattgctttgaaagcgaattcatttcatatttagtatacaaaccaaaaacacaaggaggagtatgaatggaaacaacaacgatcagagagcctgtgtcagcatcaaaaagtaaaatcaaagaaatgaagactaaattaaaaaagagtcgacagttatatttgtttgtcctgcctgcttttttgattattctgattttttcttatgggccgatgtatggtgtgatcatcgcctttaaagactatatgccttctttgggaatattcgaaagtccttgggtagggttcaaacattttcaacgcttttttgattcttattacttctgggatctaatgaaaaatacattaggtatcagtttgtactctttgatcgtcggatttccgctaccgatcatccttgcactggctttgaatgaaatcaaggatggtccattcaaaaaaattacccagacagtcacgtatgccccaaactttatcgcagtagtggtaatggtcggaatggttattgcatttctgtctccttccactgggatcatcaatcactttctagattttatcggcgtgggaagaatcaattttatgactgaaccgcggtggttcaaaacaatctatgtattatcaggcgtctggcaaggcacaggttggggatcggttatttacttggcagcattgtctggagtggatactcagctgcatgaagctgccaccatcgatggtgcttctcggctccaaagagtttggtatatcaatattccaacgataatgccgaccatggtgattttactgatcatgagttttggtagtttgatgtcggtgggattcgaaaaaatcattttgatgcaaaacccattgaatatggaatcatcgaatgtcattgcaaccttcgtttatcagcaagggcttttagatgcacaatatagttttgcagcagctgttgggttattcaactcgttgatcaattccattctcttgattttagtcaacgggattgcgaaacggctgagcgattcgagtctcttatagaaaggtggtataggaatgaaaacaacttcattagtgaaagatacacgtgcagataaaatctttttggtttttgtttatttctttttagccatagcattactaatcgttctctatccattgatctatatcgttagtgcgtcgatttcaaatcctcatttagtcaactcgggggaaatgtggttattgccaaaaggggtcacctttgaaggctatcgaactctcttaggcaatagcagcatctggcgcggctacttaaatacgatctattacactgttttaggaacatccatcaatttgttggtgacactgccttgtgcttatgcactctccagagatgatttttatggcagaagagcttttaccaatttcatgctagtgacaatggttctttctgggggcttgatccctagctatttactgatccgcagcttagggatgttgaatacggtttgggctttggttatcccaggagctgtctctgtctataatgtggtcgttacgcggaccttttttcaaacgacgatcccaagagagatggaagaagcggcaatcgtggatggctgctcggattttcgtttattcatgcagatcgtactgcctttatctacgccaatcattgcagtcatggcacttttttacggggtagggcactggaacagtttcttcagcgcattgatctatctgtcagataaatccatgtatccattacaaatgattttacgggaaattttgattttacaagatatgtcatcaaatactgtcagcaatgtgacttccgaaatggccagtatgttatacagcaagcaacagttagcagaggtcatcaaatacggtgtcatgatcgtttcatcattaccggtcattattgtctatccatttttgcagaaatattttgtcaaaggcatgatggtaggatcaattaaaggataaaacatagaggaggaagaagatgggaatgaaaaaaattttaggagtaacaggggtgtttttgtgcagtgcacttttactcagtgggtgcgggaacacaaaaaaggaaacaaccggagaaaatgaaggggtagccatcaatcatgacagccaatttccgatcattaaagaaggcgaagaactgacgctgaacattatggcgccaggagtaggtatggcagaatgggaagatatgccgacgctgcaggattatcaagaaaaaacaggaatcaaactgacttatacgacacccccttctgctgactttagtaccaagttgaacttagcatttgcttcaggggatctgccggatatcgtttatggcgcaggatcgaattcgctcacttcttcaatggagatcgattatggttcccaaggaattctgctgccgttagaagaatatatcacgccggaaattatgcctaatctttatgcattgacccaagaagacccgtccatcttaaaatcgatcaccacaccagatggccatatttattcattgccgatgatttcgagaaatgcgacatctatttggtggcaaggtccgatgtggtacaacggaacgtggctagataagttgaatgtcaaggaactgccaaagacaacggatgaattgtatgatttgctgacacgattcaagaacgaagatcccaatggtaatggcaaagccgatgagattcctttgaccgatgtcgatatgaattcaacaagggtatggctgatggcagcttttgggttacggacacgaggcgttcaagtagatgatgatgtggtttcttatacaccaatctcggaaaactataaagcattccttgagtatatgaacaaattgtatagtgaaggtttgttggatgcggaagtttatggccaatccgacgaacagaaaaaagcaaaaggacaaaatgatcagttgggcttgttcgccgattacttcagcttctttacgacaggccgcagcgagattgaagcgatgaacgatgccatgttccaaccattgacttcaaaatggtcgccagaagcagtgattccaggaagtccacgaatttctcggggcacctttgccatcacaaatgtcaatccatcgccggaagcttcgatgcgctgggtggattacttctattctgaagaaggtacgaaatatatcgaacaaggacctgaaggcgttctttgggagtacaaagaaaacgctgacggccaaaaagtacgagtttatgcagaaggcattgatacagaaaatacagaagatgaacgtggcaagatcacaccagcatacgggttgacaacaccgaacattgttatcgatacgacaggtgaatatcaaatcttgaaatccgcggatgaacaacctgatactcgtttcagtgactgggtggccaaagaaacagcagataagatggatgacattgcggaagtgccatttccattactttatctgactgtagaagaaaatgataaagtggctgctacggctactgacttgacaacgtatgtcgaacaaatggaagccaaattcattacgggtgtcgagccaatcagtaattgggataaatatgtttcgacgatcgagtccatggggatcgatgactacatttccgtttaccaaacagcatatgatcgttggaaagagaactagagtcaaggcaataggagaagcgggcttggacaatttcttgtctacccgcttttttcctcctcagaaaccgagtaaaggagagaatacagcgtgcagttatttgaatttgaacgtatccgtaagattttatttcaattaaagaattaccggattcgctatcaggtgcctgttaatgacttgcagttaaagcaagaaaactgggcaccctatgtgcaaggaactttttttggagaaaagaattgttattacacaatgaaaggaacttttgaactaccggaagactggaaagagatgtcggttgctttgcaagtctattcttcgctctctgaatgggacaatacgacaaatccgcaaatgaaagtgttcttgaatgggaattacattcaggcaattgatgtcaaccatcgagaagtgcggttggatcccacggagctaacaggaacaatagccttacagatcgatattttttcgggacgagaagagaagaagtttccgctttacgtgaatctattggcgatcgatcctatcgttgagcaagtctggtttgatttctcgacgatttttgacagttggcgtgccattaggaaatttggcggagaagaacaaatctatcaaagctgtctgtcacaagctgccaatgcattagattttcgagccccctatacgccgcgattctatgaaggcctcacaaacgcgcaagaatgtctgcaagcgtgttacagccaagagattcgtcaaaaagtgaccgcagtcgggcatacccacatcgatctggcatggctttggacggcacagcaagcggttgaaaaaggagaacgcagttttcagaccgtattaaaattgatggatgaataccctgaatatacgtttctccaaagccaaccccagttatatcaagcgatcaaagaacaatatcctgagttatatcaggcaatcaaagagaagattaaatctggacgctgggaagtagaaggtgctatgtgggtagaagcagattgcaacttgacctccggtgaatcattggtaaggcagattttatacggcaaacgctttatcaaagaagagtttgatcatgagagtcagattttgtggctgccggatgtttttggctattccgctgcattgccacagatcttgcaaaagaccaatacaccttatttcatgacaactaaattgtcttggaatcaattcaatcagattccttatgattcgttttactggcaagggatcgatggcagcagagttttgactcactttattacaacgatcagtgaaggctacagtccaagaccctactacaccacttacaatgggcttttagacccttatacagtcaaaggcagctttgaacggtaccaacaaaaagatcagcatgatgagatcttgattgcatacggctatggagacggcggcggcggacctactagagagatgctggagacaaaacagcggttatcaaaaccactccctcagatgccagtgatcactggcgatcatgcgggcaaattttttgaccgattagccgcagcttttgctcattcagaagccccggtctggtttggcgaactctattttgagtaccatcgtgggacactgacctccatcggtaaaaataagaaagccaaccgcaaaggcgaatttttattgcaaactattgagaagctttacagtgcctatcgaagcgaagcgtatccgcaagagctcctcgaaaggctctggaaaagattgttgttcaatcaatttcacgatattttgccaggaagttcgattggcgaagtgtaccagcagacagaagaagagtatgctgctctttttgaagaaggcgagcaattgatccagtccctcgtggcaggaggaaccgccagtgatgcaaatcatcaggtggtctataatccattaggctttactcgtgatgccgtaatcaaagttgatagtccggcgattcaagaagattatctgacacagcgaaccgaagatggttgtttgctggtcaaagttccacaagtccctagcttaggtctgcgtcccctaacgttgagggagactatctcagaaccagtagaacaagagtgtgttccgttgactcgtcaactggaaacgaccgactttgtcgtaacatttaacgcggcatatgaaatgactgctctttttgacaaaagacaccagcgagaggtcttgccagcaggagaagtgatgaatcaattgattgcttatgaagacttaccgatggattatgatgcgtgggatatagacatctactacgatcgtaaagcttatccagtagaggatgtgactgacgcatcaatcgtcgagcaaggcgagattcgtgacacgatccgtatcaaacggacgtttgagcaatcaacgatcattcagctgatccatttctatcatggaaccggcaggatcgactttgagacaacggtcgattggcatcagcatcatcttttattgaaggcgcagttgccaattgccgtcaatacgctagatgccactttcgatatccaatttgggaatgtcaaacgtgccatccacaaaaataccacttgggatttggcacgttttgagagttgtgggcaaaaatgggtcgacttgtctgaagatggttatggcgtcagtgtgttgacggattgtaaatacggattcagcacagcttaccaaaaaattggtctctctcttatcaagtcggcgactgatccctatccagaagcagatcaaggacttcattcgtttacctattctctctatgttcatgaaggtgactggaaaaaaggacaaacgatggaagaagcgttggcactcaatgtaccagcatatgtattggcagattttgatcagcagcaagagcaatcttttttacaagtggatcacaataatgtgctgatcgattcggtcaaaaaggctgaagcagatgaagccatcgtggtacgtttgtatgaataccacaatcgcaaaacgacatgccgcttgaccgcagctaaaaaaatcaaacgagcagtgctaacgaatttattggaagaggaacagcaggagttagtggtcacgggcgtgtgccaccaagtggtgattcctttcaacccttatgaaattcaaacggtcaaggtctattttgactaatcggcatttttgatgataggagtttaaaatgatcgaagaaattgtaaagaagatgtccctaaaagaaaaaatcggccagttgaatcagcgattgtatggctggcaagtttatcagaaaaaggaaggaaaactttatttgacagactacttcaagtcggaagttgctcgctttggctcgattggctggatctacggcgttttccgagcagatccttggtcgggcaaggacgcaacaacgggtctctcggtggaagaatcacgggaagtcagccggatgattcaggactatttaaaagaacatactcgtcttggaatcccagcttttttgacagaagaatgtcctcatggtcatcaaggattagcagcaacaacactgccggtcaatttcagtacaggggctagttggaatcctgatctttatcagagcgtgcagacgttcgtggcacaagagttacgagctaaaggggcgcaagttgggctgatctctaccttggatatcgtacgagatcctaggtggggacgaaccgaggaatgtttcagtgaagatccctacttagccagttgttttacgcaagctgcggtcaagggaatgcaaggggaaatacttggtcatgaaccgacaacccatgtactggccgtgttaaaacattttgcagctcaaggttcaagtatgggcgggcacaatgcaggaccagtcaatattggggagcaagaattgcgagagattcatttacccgctatgctggcgggaattcaggcaggggcactagggtgcatggctgcttataatgattgggatggtgtcccttgtcacgcgaaccctcgcttacttcaagagattttgcgagaggaagccggctttgcaggagttgtgatggcagatggttgtgcgttggaccgtttagcggattggctaggaaacaaaccagaagcggcagcccgggccatgaacagcggcgtagacatcagtttatgggacaatgttttccctcagttggaagctgctgttgatcaagggttgattaagcaagaaaccattgatcgatccgtgatgcgcgttctgaaactgaaagagcagctaggactttttgacgaaccggtgcctacggtgtccgttccggatcaaaagcagtttcaagaaagtgcaactcgtttagcagaagaagccatcgttttgttgaaaaatgagcaagtcttaccgttaaagaaacaaagacaaacaattgctgttattggtcctcatagcaaaaacagctatcatcagctaggggactatactcctttcaaagaactgtctgagtgccgcaatctgtgggaggggttgctggaaatcaaggggaccgaaaccacttttattcaagcagatggctgcggcatcacagaaggaaccaaagagcaactgactgccgcatgccaagcggcagcaacagcggatcaaatcattttaacgattggcggctctagtattcgtgacttttcgacggattttgataagaatggagctgccttgcaaggatctgcggagatgaccagtggggaaaatatcgatctggcgtctttggcattgccagaatgtcaaaaacgattgattactgaattgaaaaaatttcagaaacctctgatcggtattgtcattgctggccgtcctcatctgttaagtgaggtcagtaccgcttttgatgcgttgctttttgcaggttatccagggcaatttggcggaagtgcgctagctcggattctttttggcgaaacgaatcccagtgggaaactagctgtttctattccagatgaaaatgggcagctgccagtttattacaactaccgtgaggctgctttccagagagattacacagattgttcaggaacccctcgttatgggtttggttatggtctaagctatgcagaatttatgcttaagggaatccatgcgcagtatgctccgcaagcaatccaaattaatggaacaatcgagaatctttcggtgatagcaggagctgaagtggtacaagtgtaccttcgcaattactcacagcaggtcttaccgcgtgtcaaagtgttatgcggttttcaaaaagtctttttgccagccaaaagcaccgtcgacttttctctaacagtttcttatgaaacgttgaaacggttgaacatttcaccaaatgaattgccagctgattttatcatccaagtcgaagcagccaatcagaaacaagtattcacgaagccattgaaacaagaagaaaatggaaaaggagagaaatcatgttaaaattcccggaaggatttttatggggagcagctgcttctgctcctcaaacggaaggcgctgcggcgattgatggcaaaagcccttcaacttgggataaatggttcgaattggagccagacaagttctacgatcacgtaggacctagtgatacttcgaatacctaccgacactttcgagaagatgtggcgctgatgaaagccatgaatctgaactcttatcggacgtcaattgcttggacacgactagtacctgatggaaagacggtcaaccctcaagcagtcaccttctatcgtgcctattttcaagaaatggtcgatcaaggaatcgaacctatcatcaatttgttccattttgatatgccgtggtggttaatggaaagaggtggttgggaagccagagaatcggtagattactttgccgcttacgctcgtatcgcctttgagcaatttggcgacattgtcaaaaaatgggccacattcaacgaacctttagttcatattgaatgcggatatatgggggatgcccattggcctaaagttcataattttaaacgagcgatccaagtaggctatcatacactgttagctcacgcaaaagcagtagctgcttttcgcgaacttgcgattcctaacggagagatagcgattatcttaaatttatcgcccgtctatccgaaaagtccgcagtctgctgatcttgaagctgctgaatgggcagacttactctatattcgcagttttttagactgtacagtcctcggacgatttccagaaaaattagtcgcgatgctgaaaaagtcaggtcttgctcctgtaacagaggagggggaccgagaactttttgccttaaatacggtggactttattggttgcaattactaccagccattacgagttcaagccccgattgcgccgaacgatccaatcacagggccgagggatctttttcgaggctatgattggccggacaaaaaaatcaaccctcatcgcggttgggaaatctttccgcaaggtatttatgacattgccatgcgtctaaagaatagctatggcacgattccttggtatatttctgaaaatggtatgggggtttctcaagaagaacgcttcgcaacgcaagagggggagattaatgacacctatcgcatcgaatttgtaacagatcatctcaaagaactgcagcgggcgatcgaagcaggagccccttgcttcggttatcatatgtggacatttatcgattgttggagctggctgaatgcgtataaaaatcgttatgggtattatcgagtagatttgacagatgatacccgaacaccaaaagcgtcgagcttttggatggcgcaagtagcaaaggacaatgggatcgattcagggaatggacctgattagccagcaaataaagcatgcttcagagggacgattggacctctggagcatgctttgagtgtttcaactgattttattttatgtttaagtttcgaccactgaatttagcaggcgcatttgacgatcagagatatttgtgacgatagtcagcaatggcctgtcttgattcgtagatattttgagccagctgttcatttttactcaaaaagacatagaacagcacatcaactgccaaaagatgagcaataatcgagttggttgctgcactgcgcatattggcttctttcggtctggaaacttgcagcggaacatctgctaatttcgaaagggaattactgccaaagcgagtcaaagatagaactggaatccccatctccttcgtaaactccgcaaggtgtaggatttcaggtgtttgaccactgtttgagacagcccagagcaaacattctttttcgtgtttgatcaattgaggcaacagcgaattatagtcggtttcgaaaataaccactttgcctaagcgagtccatttttgttggatatcttgagcaatcaaagaggaagcaccgataccgcatacgaagatccgattgcgggttttcagtaggtccgctgctgccagcattacttgttcttctaaaaggtccgcagtctcatgcatagtcacttgggcattatggctcaatttcgcagtaatatcatgaaaagattcgttcaatgcaacatctgcatagccaatgatctcctcatgggtttgtcgggagccagattccgcagaaagctgaatcttaagatcagttaggctggaaaagcctgttttctttgcaaaacgaacaactgtaggggcgctgatcccggtagcttgagccaactgactcgcagtcatcgaaggaactttttcagaattttttttgatgtaatcaaaaagttttttttcggaattggataattcgctctggatactttcaatgcgagaaaggacgctcataaggtcacctgctttaagaaatttctagatttagtataccataagttggagtgttgctttcattttaaaatgaaaagattcagcgaagaaacttgcatttttaggtagaataaagtaaagtaattacgtgtgaatacacgctacctgttacttggttcaacgagtcaccaacgttttactcagtcgcaggtgaaaaaagaaaaaagaggtgaaaaacatggcaattacgaaagaacgcaaaaacgaaatcatcaacaaatttgctcgtcatgaaggagatactggttctccagaagttcaaatcgctgttcttacagaagaaatcaaccatttgaacgaacatgcacgtatgcacaaaaaagaccaccattcataccgtggcctaatgaaaaaagttggtcaccgtcgtaacttattagcatacctacgtcaaaaagacgtacaacgttaccgcgaattgatccaagctttaggattacgtcgttaatcaaacaaagaaaagtgaggttcaacccgaatctcacttttttgctatgaatcactgcgactgggcggcacaagccgtacagagcagatgatgaatagtactaggcgactaaccaggagcgtagtcacccgagcggaatcactgcgactgggcggcacaagccgtacagagcagatgatgaatagtactaggcgactaaccaggagcgtagtcacccgagcggaatcactgcgactgggcggcacaagccgtacagagcagatgatgaatagtactaggcgactaataatagtggccccatctttttaacaaactcaattagcgggacttgactggtgaatcaaacccgcaactaaaaaagaatctctgagacacggcgagcagcttcctactaaccaaatgaaagcagcggaagcaccgatccacttttttcatttgtttagtagtgacttgcttggctcagaaaaaaaggagcagatcatgacagaaaaacaagtattcaaaacgatttggggcgggcgtccgctacaagttgaagttggccaattagccaaacaagcaaatggcgcagtactcgtccgctatggcgatacagtagttcttagtgcagccgttgcttcaaaagaagcaaaagatacagacttcttccctttaacgatcaattatgaagaaaaaatgtacgcagtcgggaaagttcctggtggtttcatcaaacgtgaaggtcgtccaagtaccgaagcaacattgactgctcgtttgatcgaccgtccaatccgtccaatgtttgcggatggtttccgaaatgaagtccaagtgacaaacattgtcatgagtgtggaacaagattgctcaccagcaatggctgcaatgctaggctcttctttagcgttgtctatttccgatgtgccttttgacggaccaatcgctggtgttgaagttggccgtgtcaatggggaatatgtgttgaatccaaccgttgaacaagcagagcaaacagatatcgaattgacggttgctggtacgaaaaaagccatcaacatggtagaatcaggagcgaaagaagtttctgaagatgatatgttaggcgctttgctgttcggttttgaagcaatcaaagaattagttgttttccaagaagaaatcgttgcagcagtcggtaaaccaaaaatggaagtgactttgcttcaagtagatgctgacttgaaaaaagaaattttcgatggctactatcaaacaatgaaaacggctgttatgaccgaagaaaaattggctcgtgaagacgagatcgacaacgtcaaagaaacagttaaagaagtttatgcagaaaaatttgcgggtcatgaggatgaagcgcagcttctaaaagaagtgaaacaaatcgcagaagaccttgaaaaagatgttgtccgtgaattgatcacgatcgacaaaattcgtcccgatggccggaaattggatgaaattcgtccattagcctcagaagtcggtctgttgcctcgtgttcatggttcaggactattcactcgtgggcaaacgcaagcattatctgcttgtacattggcaccattgggtgaacatcaaatcattgatggtttaggggtagaagaatcaaaacggttcatccaccactataatttcccgcagttttcagttggttcaacaggacgtgccggttctccaggccgtcgtgagatcggacatggcgctttaggtgaacgtgccttggcgcaagtaatcccaagtgaagaggatttcccttacacaatccgtttagtggcagaagtattagaatccaatggttcatcctcacaagcaagtatttgtgcgggtacattggcattgatggatgctggtgttccaatcaaagcccctgttgctggtatcgcgatgggacttgtctctgatggcgaaaactatacgatcttgaccgacatccaaggattggaagatcatttaggcgatatggactttaaagttgccggaacaaaagatggaatcacagccttacaaatggatatcaagatccaaggaatcaccgagcaaatcttaactgaagctctatcgcaagcgaaaaaagcacggatggaaatcttaaatgaattgacttcaactattgctgcgccacgggaagaattgagtccatacgcaccgaagatcgagatgatccaaatcgacccagccaaaatcaaagatgtgattggtaaaggtggcgacacgatcaatggcatcattgatgaaacaggcgtgaagatcgacatcgatcaagacggaaaagtatcaattgcttcttctgatgcggaaatgatcaagaaagctattaagatcattgaagatctaacaaaagaagtcaaagttggcgaagtttatttaggaaaagttgttcgtgttgaaaaattcggcgcttttgtcaacttgatcaaaggcaaagatgggttagttcacatttctcaacttgcaaatgaacgggtcaacaaagtagaagatgttgtcaaagaaggcgatgaagttcttgtgaaagtcacagagatcgacaaacaaggtcgaattaatttgtctcgcaaagcattattgactgacgataaagcagagaagaaataattttcttaactagttatccgcaagagaagattttgcaaacgtaaatcaacgtccaaccccccagtaatcgattcgattactggggggtttttacgacataaggcacagacatttcgctgataataaggtaaactgactcaaagaggtcgggcaatcaaaaattcaaaaaacgtatagaaggtgaaaaaatgaaagccacacagggaagtgtttttcgacgacgagaggccttgatcacctacttagataagtatgattatgggactgtttcagaattagcggatcgatttcaagtatcagaagtgacgattcgcagggatttgttgtttctggaaaaaaagcagttgattgaacgttattatggcggcgtgaaacggatcaagaaatcagaaaaaagagaatcccagcaacttggatcggtagaagaatttccttggcagcgactgcttccaccgttacaccttttgctgcaagaaaagaaattgatttttgtgggggctggacgctggtcgaaagaattgatccacgcagttgctgattttgatttaacgattgtgaccaatgaccattccgcattgattgatctaaaaccaggacgggcgattgtttgtctgtgtggaggagaagtggaaagcaactccactgcgttagtcggagatatagcgacactggctttcagcaaatatacggctgatttgtgtttgattgaagcctcaggaatcgactcccatgaaatcacaacaacgacactaagtgaatcctttgtgtatcggacgatgcttcagcatactcaaggagagaaaatcatctatacggaaggagaaaatatcggccatgtccgaggatttatgattgatcgtacgtttatggcgaatcgcttgtttagcaataggcaacttacagagatcgagacggcgcaattttcttctcaaggtctgcagttttcgctgctatgattttaatttggcattgaagcttttctcagacaatcaattaaggagaatcgttcataaatattctttcatgaacagttcttgtccggctattgcttttgatcaaggagacgattatcctaaataccagaaagcgatttactaaaaaagacaggagaacatcatgacatcaaaatttccaacagattttttatggggagcatccatttccgcacatcaaacagaaggagcttatttagcggatggtaaaggactaagtgttcaagatactcgtccccgagacaataacgagatcgccgattttacagtagcggtggatcattaccatcggtacaaggaagatatcgccttgttagcagaactaggaatcaaagtttttcgcttttcaattgcatggtcacggatctaccctgaggggcggggaagtgttaaccagaaaggattggaccattatagtgctgtcatcgacgaactgttgaagcagggaatccaaccatttattacgttaaatcattttgatttaccacaagcattggaagatcaaggcggctggacaaatcgcagtacagttgaagcttttgaaacctatgctaagacattgttcaacgcttatggtgatcgggtgacccattggttgacgatcaatgaaccgaatatcatgctcttagtcgatcgcaagatactaggcaaaacgattgctctacctgagaagtaccagcaattccatcatctgatgattgctgaaaagcttgccttcaaacattgccatgaactcgttccaaatggaaaaattggaccagtccctaatatctcgcttgtttatgcagcaaccagcaagccggaagacaatcaggcggccctttatttcaatagcgttcggaattgggcgtatttagattttgcctgcttaggacgctacaatacagtctttcaagattacttgaatcaaaatggggtgaagatcactatccacccagaggatcaggctttgatgaccagtgccttcccagactttgtagctatgaatttctatacaacggtcacagttgaacagccaacgatggaaggagacatgacgaatgggatcagtgatcaacaaagtgaagacatcatggaacgagggttttataaaggatttacgaatccctatttgaagaaaaatgcgtttaactggaccattgatcctctgggcttaaaaacgactttgcaaacactctatgatcgctaccatctaccaatcctcatcacagaaaacggtttgggagcagaagatcatctggaagaaaacggcgcagtccatgattcttaccgtatcgactatttgcagcagcacatccagcaatgtctagcagctatcgagtcaggagtggaattgattggctatagtccttggtctgcgatcgatttgatcagtgtccatgaaggcatcaaaaagcgctatggttttatttatgtggatcggaatgatgccgatgaaaaagagcaaaagcgtgtgaaaaaagatagtttttactggtatcaaaagttgatcgaaaacggacattgggagggataagcaatgaatcatgtctttacttttttagagcagcgattgatgccgccattaaataaagtcgctaacttgcgttttatccgggcaattatgcaagcgggagtcatcacggttcctttcacgatcgttggctcgatttttttgatcatcaataacctgcctcaaattattccgccgctggccagcttttttgaacagacgattttgaaattttccccgctttatagtgtcgcgacaactatgtctatcggctcgatcgcactcttttattgtttagccactgcgtattatttaacggacatctatcgcaaagaagaaaaactccaattgagcagctttgttggcgcaattcttgggttgtttgcatttttgatgacgatcattcaagtcgatatttcagatagtggggcacaattgcttcaaacaactggagagacagctatcatctataatggtgtagcacttggttcttgggtgacacggtttagtggggtcggtatttttatcggtatccttacggcggtgctggcaacccaagtctatcgtttttgtgttaaaaagaaaatcacgatccaaatgccagcgggagtaccagatggggtcagtaaagcatttgcttccctgattccagcgattattattgcttttttgatgattctgatcaatggctgtttagccgtttttcataccgacttgcatggtttgttgtcaaaaccatttgaatttgtaaaagatttgacaggttcttggctagggatcattgtaatcatgttgttgattcatttgttgtgggccgttggtgttcacggaacagccgtcatcaaaaacagttttatcaatcctattttattagttgctttaaccgaaaacatcgatggagcaaccaacatttttgccggtgattttgtcaatatgtacatttttattggcggtgctggcagtacgttagggttggtcttgttgatgctgtttcgagctaaatcccaacagttgaaagtattgggcaaagcggcgatccttccaggattgttcaatatcaatgaaccagtgatctttggtgcgccaatcgtctataatccttatttgattattccttttattgtgacaccgctgatcaatgtgacgattgcttattttgctacatcctttggctttgtagctaaagtgatcaccgggattccttggatctcacctgttgggattggagcatttcttggaactggcggtgattttcgcggaatcttgatcgctatccttaatttattgatttcggttgtctgctattatccatttttccgaatgtacgatagtaaactttttgcggagcagcaagcaaacgaagcagaagcgactctccatgatcagtagacaaaaagagcgtgggacaaaagtaaaaaacacttttgtcccacgctctaaacacgtctaaatggcggaagcagaagcaactccgagaaattaatcgaactaccccaaaatttgaaaagcaatttccgtgtattcctccttattttgcggagtttaacatttctgtcccagcctcttttttagcgaaaactataatccgacaacgaaatatgccgggcatgacaccagtctttgacaggaccggagaaaattagcggtacattggtcaaatcctgtgtcagggtttgtccgaccatggtgtagagcagctgaagctgttctttccaagactggatggtggcaatcgtttcttcaggtcctttatctaagagcatggtcaaaatcgtagcagagattccgacacttttggcaccaagacataaagctttgaaaatatcaaaggcatctcgaatccctcctgaagcgattgtcgtgaaggagtgttgcacttcgttggcttctagtaaagaaataaccgtcgattggccgaagtgattcaagtaagccatttctcgtttttttctgcgggcattttcaatttgggtaaaactcgttccgccgctaccagcaacatcgatcgtttgtacgcctaccgaaatcaattgctgaatagtctctcgggtcataccaaaaccgacttcttttacgacaactggtactggagccgcctttacgatttgttccagcagacttagccaattgctgaattcacggtccccttctggcatcaccaattcttgaggggcattcagatggatctgtaaggcatcggcttcaaataagtcgatcgcacgcaaggcattttcaacggaactaccagcaccgacatttgctaaaagaaagccctctggattgacttggcgaacgacttggaacgtgtcggacagcgctgggtcttttaatgcagctgagacagaaccagtcgccatcatcaggtcacaagctttcgcaacttcagccaagtcttggttgatttttttgcttttctcacttccgcctgtcatggcgttgatgaaaaaaggggtagcgaaagagcggccaaagagttccgtttccaaagtgacttgtgcgctatcgatctcgggaaaggactggtgaataatttgaaccgcatcaaaatcattcaaccgtggcttgtgaaaggcttttgccaatgagacgtgttcatcttttcgattcattaaatctcctcccgataatgatagacatgcagcggcaatggaataatgtcggctttttcccaagcgctcatcaatggtaagatcccggttttttgatcgacgatcacaatgccgcaatccccgccgccagcgcctgaagacttggcggccccgcgataggtttctgctaagtcacatagtttctttaaagcgggtgtttcaatggttacaccagtcagactagataatcctacaagtaattttcgattttcggtaatcatttttttgattgttcggctgtcttcatttaaaaagccatcaatcaaacgattgacacagtctttgctgtctgccaaaaatttggcatagcccttttctttggcttcttttgattggtagacttggtcaactaaatcagaagtggaagcaggactacctgtccacccaatcaacaggcgcaatgattttgggacaatcaatggacggatcgaaagctctggccaatcactggtcaatagctgagtcaatgtccattcctgctgttttcgtaagacccactcatgatcaaatgtggaaaaagccagccagccgccatagcaagaagcagcaatgtcaccacacgagccattcccttgcacggccaaatgggccaatgcggcgatcttgaattgcgtcaagcgatccatttttagatcatagtagaggttgagtgctttgacggtagcaacggtcactgcaccgctagaaccaagtccatattttcgaccgttggaattatctaactcactcgttacttttaagtcataaaaagagagcagggttcctttttcttgagcgtatttttctgttagacgaatagcagctagaatgtaatgaaaaggattttctcggtggtccagtactagttcgccattgcggcgggtccagcggatcggcaagtcactgtactgggcagattggatactgccgtttttgcgggcgccttcgatcgtcacattgatgaattgatccaccgcaacgatgatcgctggatgtccaggttcaacgaccgcatactcacctgcaataaataatttgccggggactgagatttctatcatttcgacactccttcatttgtcatagacggatcggtcactgtcattggtaaatcaaccaacccttgtcctgcgtgagcaacgattaattgttcaggatgaaaatcttttttcagctgggttaatatagcttcttcgtcttttctttgacaaagcactttgacatttggtccggcatccatcgtaaagtagcaggccagccctttttgacgcaaggaacggacgcaatccattgctcgcaaggattcaggagaccagtaggtgaacggtggagtcgccgccatagtagtggcatgcatttttagggcattggcttctgtcgtttcacctaataactgaaagtctttttcgcggatggcttgctttaactttttcaaatcgtgtggtgtgctttctagccaaccagaataatagctggaagtctctacagtccgacgcatcccgtcacgactggaaacatcttttgctttgtcgttgatcaaaatgaaaagcatacttagctctttttcccagccttccgaagcaatcggtgttgcgtaagacgtgtcatcatcaccagtatgccattcgacaaagccgccaaaaatactgcgacaagcagagccagatccccgccgagcgagacgggatagttctgtttgtgataattgtaagtcaagtgctgcgttacaggctccggctaaagcagctagtccactagcagatgaagcaagaccagcagctgttggaacgaaattgcggctgttgacttgcgcgaaaaaaggacaattggcttttgcgcgtacaagatccaaaaaagcggagattttcttcgttgcagcctcactctgctgtttgtcatccaggaaaaaacggtcttgagtatattcctctgaaaaggtaacagaggtttctgtatagaaagcatctaacgtcaaagataagctgttattcattggcaagatcagtgtttcgttctccttgccccaatatttgatcaaagcaatattcgtgtaggctcgcgcctttcctttatacatgttcgtaagctcctaatccttgaatccaagtggcatgggcgccattggacaataaaatacggctgatcacttcagcctgtgtttttgtttgagtcaaagcgatcatacagccaccgcggccaccgcccgtcagctttgcgccaaaagcgccgttggctaatgccagtgacacgagatcgtccaggttttgattgctgacacctagttgccggagggtctcatgtgcgtgggtcattgcctgacctagctgcgtcagctgattatgtaagatagcttctttagcggtctttgctaaagaacctaagcggctgatagcctgactcgtttggtgtttttgcgtttcaaacagatgcgcgacgcttttgacagctgtgcgggtctgacctttgatccctgtatcggcgactaacaaaaagccatcgatcgtcaatggaaaagaagtaatcggctgccctttggtaaagtagatcgcctcgttgccgcttgttgctgcagcatcaataccgctaggatttccatgcgcgattttctcagaaaaatcgacataatccaatagccgttctttttttaactctttgtgctgccaatcaaaaaaggcccgagtcaacgcaactgcaactgccgcacttgaacccattcctcgttctgaagggattgtactaacgatcgaaacagaaaagggaccggtttgatggtcttgctgcaagcgatgaagaagttctttcacattttttaaatgcgaaggagcttcttctagtgggccgtggtaataattggaggttaaatcattcgttaggctggcagtgatcgtcacgtggacctttgcgccagcaaatggaaaagcgatggcgggttcaccatagacgaccgaatgttcacccattaatatgattttccctgtagctatgccagtaccgagtgacattcattatcctcatttctcttagaactgcagcagaagtcaaaagaatgtctcagaggaagcagcaggcaaaaaaataaaggttcccctttgatcctgtgagtcattcttttaaactaagctgcaatctacttaataattactagtgatttcatcatagatccttgtttttccgttagaacagaaaagttcgcagaaaaacgaataaaagattctttcttattttactagaagaaggctgtttcgttaagcattccgaaaaagaaatcgtaaaaaactgaaaatatttaaacttttattgaaaattttttgtttttatgcttcaaaagcgctgggttgacgatacaatatctagtagtgtatagttgattacgcaaatgaaacatacaatatttagtgatgagtgagttgggggatatgagcgtgatcgtattagcaggaactatcggcgcaggaaaatcaagtttaactgcattgttagctgatcatttaggcagtcaagcattttatgagtcaatcgatgataatgaagtgctgccgttgttttatgccgatccaaataaatatgcttttttattgcagatttattttttgaataaacgttttgatagtatcaaaaaagcattgaatgatgataataatgtattggatcgatccatttatgaagattcactgcttttccatttgaatgctgatttagggcgagcaacggatacagaagttcgggtttatgatgatttattggccaacatgttggaagaattgccttatgcagctcataaaaaacatccagatttattggtccatattcgggtttcttttgaaactatgttagaacggatcaataaacggggacgggaatatgaacagttatcctttgatcctaccttgtatgactattatcaagaattgaatctacggtatgatcaatggtatgaagaataccaagaaagtccaaaaatccaaatcgacggcgatcaattcaactttgttgaagatccagaagcagcccaaaaggtattagcgatggtcgacgaagcactggcaaaagtgcgcaaataaagcaacagctggagtccagcccataaaagtggggattccagctgttttcttttataatagaagaaagcgaacatgtaacgtgtggagggaaaccagtggaaaaaaaacgattttacaatggccgttatgaatggattcaagtggatcaacaagacagtagcagtattgcgcgtttacaaagacagcaccagttgactgatgagatgttaacttactcattagacaagaatgaacgtgcccgtgtggagttcgatactgatgatcaagcattgttgttggtgttcaacgtacctcaacaagaaaagaaagacaatcattttgaaacaagtccgatgacgtttatcttaaaaaaagatcggctgtttactttttcttcgagaaatacacaatatgtgattccgatgatggaacggatactcgtgcaaaatcctttgcaaacaccgattcattttctttttaatagtctttttttgatctcaggaactttttttcctttagtcgaagaagtcaatagcgatcgcgtgcatctcaatcaacggctgcgggaaaagaccaccaataaaaatttgttggagatgtctgacttggagatcggactcgtttatctggtttcggcaacgaaacaaaatgccgttttattagaacagatcaaagctttgtcgttctttcgtttaatggacgacaatgaaaaagagcagttggatgatgcactgatcgaagcgaaacaagccgttgaaatgactcagttagcgtttcaaattctggaacaattgtcaggtacgtacaataatttgttgaacaacaacttgaacgacacgatgaaattcctgactgtttggtcgttgttgctgacggtaccatcgatcgttaccagcttctttggcatgaacgttccattgcccttcacgaataccgtgtttggctggggaatcgctctgctgatcagtttagtcttgtcaggatggatgttgattgcactctggcgcagaatcaagtgatgcttcagtcaatcactagacctaaccccgctgcaatcactaatgcttgttcttggtcaacgatcaatccccgcaacaattcttgcgaaagagcgattttctggaaaggattggtccgcagatccagctgatagagtttggttcggaaccaattactgtttgtcagctgattgtgctgcaactggagatttttccattggacttcgtaaaattctgtgtcattcagctggcactctgcaaagcggatcgttttgagattggtgttgctgaaggaagcaaaattgccgacgcaagattcaaatgtacagtcacgaaaataactttctgcaaaatttgtaccggtcagcttgcagtttttgaagtgtacttgatgaaagctagcgcccaaacattccatgttggaaaagtcgcagttttcaaagaaaacattttggcattcccaatgctctagtcttgtcttttgcatggtgacctttttcaagtggcactgttttaaaatgagacccgtacaagcgtcataactggcatcagtttctgtaaaaaaagcttgttcaaaaatttcttcatcttcaagataaaaatcttttgtttctgagtattcaataatcggtaaaagaggatccggctgcttttttttcattttgcacctcaaaattttgtttttttaatagtataccatgttttgagcgatgccttttgcagtgcaaagatgtttgatggatagattgtgaatttaattcaataggctaactttagctgctgaaatagcaaggttttatgaaaaataaatacgcttatattcacaaggttatgaattgttttaagaaaaatcttcatttcagaagcataattcaaggataattcggcaataaccagtaaaaactgtcatttttttaacggtttgcgaaaatcttgatagtttttaaattcacaatgtagctataatgaaaccataaacaaaagggggaaatttttccatgacaaaaacagtgattattggtgcgaaccacgcagggattgccgcagcaaataccttattagacaattaccaagatcaagaagttgtaatgatcgatcggaatacaaacctcagttaccttggttgtgggactgcattatgggttggacgtcaaatcgattcgtatgaaggcttattctatacaaaacgggaagattttgaggcaaagggagcaaaaatctatatggaaacaactgttgaccatattgattttgagaaaaaaacggttcatgcagtaacaaaagatggtgaagaagtggtagaaacatatgacaaacttgttttagcaacaggttcagtaccaatttcgccaaaagtacctggtcgtgatttagccaatattcatttcttgaagagattccaagatggccaatctgtggataaagaactagcagctgaagaagtaaaaaatgttgctgtcatcggggccggctatattggagtggaaattgcagaagctgcaaaacgtcgtggtaaaaacgttcttttatttgatgccgctaaccgtgcattaccaaactactatgacaaatggttcacggatgacatggatcaaaacttagcagagcatgggatcgaattgcactttggtgaattagctcgagaatacaaaggaaccgacaaagtagaagcagtggtaacggataatggagaatatccagtggatcttgtgatcaatgcgatcggcttcttgccaaacaatacattaggcaaagagcacttggaactatttacgaatggtgcctacttggtagaccgtcaccaacaaacaagtgacccagatgtttttgcggttggagactgtgcaacggtttattcaaatgcattgcaacaaacgacctacatcgctttagcaacaaatgccgttcgctcagggatcgtagctggccataacattggcggtacatcattggaatcaactggggtccaaggatcaaacggaatctcaatctttggttacaacatggtttctaccggtctttccgtagaagcagcagaacgtaacggtgtgaaagtgaagtattcagattatgaagatacgcaaaaacctggattcatgaaagaaaacgataccgtgaaaatccggattgtttacgaagaagaatcacgtcgggtgattggtgcccaaatggcatcacgtacttcagaaatcgctatgggaattcacatgttctcattagcaattgaagaaggtgtaaccatcgacaagatgaaattacttgatatcttcttcttaccacacttcaatcaaccatacaactacatcacaatggctgcattgaaagctgaataataaatagctgagggagctgtgacaaaaatcttgtcgcagcttcttttttcaaataaacgattagaagtagcttctttggaaccaagccgaaacttcaggtggctggtcacttttgttaagcgctcttttttgaaataatcatgaaaatcattgacaagaactaaaaaaagcagtatactataaaagttgagaaattaaagcagaagcacccgcttctcgcctgagtgactgtatcgctgggcagaataggattcctacattttgtgtatggagtacgtgcgggttcgtgaagaactcgttttttttattgtctgatttcgaatcgacaagcttttctttctctcaaaaaactcggaggtgaatgaccatagcaaaggatatgatggtaaacgacggcattcgtgcacgtgaattgcgtttgattgatcaaaacggcgaacaacttggtgtaaagagtaaagctgaagcattgcaaattgcagaacgagcaaaccttgatgtggtattggtggcaccaaatgcgaaaccaccggtagcaagaattatggattacggaaaatatcgttttgagcaacagaagaaagaccgtgaagctcgtaaaaaacaaaaagtaatcaacattaaagaggttcgtttaagtccaacgatcgacgtcaatgatttcaacacaaagttgcgtaatgcacgtaaattccttgaaaaaggggacaaagtaaaagcttcgatccgtttcaaaggccgtgccattacccataaagagattggtcagaaagtgttggatcgtttggctgaagaaacagctgatttagcatccgttgaacaaaaaccaaaaatggatggacgcagcatgttcttagtattatcgccaaaaaatgataaataatgactcactgagtttcagtttaaagtcagataacgaaagattttgaggaggaaattagttatgccaaaacaaaaaacacaccgcggattagcaaaacgcgtaaaacgtactggcggcggcggattgaaacgcttccgtgcatttactagccaccgtttccacggtaaaacaaaaaaacaacgtcgtcaattgcgtaaagcttctatggtttcagctggcgattacaaacgtatccgtcaacaattagcacgcatgaaataattgcgtcccaggctttacaaattcaaacaactatcgattttcatattaggaggaattatacatggcacgtgttaaaggtggaacagtaactcgtaaacgtcgtaaaaaagtgctaaaattagcaaaaggttactacggttctaaacacactttatttaaaacagcaaaagaacaagtaatgaattcatacaactacgcataccgcgatcgtcgtcaaaagaaacgcgacttccgcaaattgtggattgctcgtatcaacgcagcggctcgtatgaatggcttaagctactcaaaattgatgcacggtttgaaattagctgaaatcgacatcaaccgcaaaatgttagctgacttggctgtaaacgatgcaacagcatttactgcattggctgaccaagcaaaagacgctttaaacaaataaactcacgttgttctacaacgattgaacccgctcaatgagcgggttttttgtttcttccgctaagcaaaataccaaattcgcttgactaatggtatagtagtctacaataaaatcggattcctgttaaggctgggaggatatcaaatgaaactagtaacgaggaatgaagtattggaagaatcaaaggcagtcctaaaaatcatcgcgggtaatagtttgttgggatttgcttatgcgaaatggatgaaacctaatgggatcatcaatggtggtgtcactagtatggcgatgattttagaaaaggtgaccaatgtaccgatcgtttatttgacatctggtattacgacccttctgctggttttttgttggctatttttaggaaaagccaattttttcaagtccattatcagcagtgtttttataatttattttttgctcttttttattatatgaagattgattttcaagtaaacctaatgcttgatttcttatttgcgagcttgttcatagcggtagggtactattgctgcatcacggctaacgcttcaactgttgggatggatgtgattgccatggctatcaacaaaaagcggcctgattttagtattgctcggggtatccgctatatcaactttatggtattaatattaggatttttgacttatggcttcaaatcagtagtaattggattactatttagttttgtcaattcttatctattagattttttgttgaaaagaagcagtcggtgatctatttggtgattcttgcttcctttcatccgcaacaaaaacgacaaactaacagtattgatccaattcaaattggggttatttcattaattgactcgcctcataaatctcttgtttatacggagatttatgaggtgttttttgttttttgtctatcaacgaatagagagaaaccgttaaaaatgcgcaatatgacaaaataagttgatttattttgaattttgtctttttcataaacaggtcaataagtgaaagagatttctcaatcccaaatcatgtgatttttaacacatatttcagaaaaaaacgaagtaaaatgtccttatttattaaaaaaatgctcaagtctgagataaaaatcgcttttatccattcatttccaggcgcaaaatgataagaattactccttttttaaaaagattactaagtaagaatgagactcaaatacttattttttgaaaggattttgtcagttcctaatagcaaaaatatccgataatctgtttagataatctttgcacttttttaggagtgatctttatgtaaaacgaaaatgttggattggttgtttaggcatgtgtaggttaggaaagatttaaaaaaatatgaaagaaggtacagaaatgaaacgaaagaaaaaattagttacaaagttcgttgttgcaacaactcttttcacagcaggtagtttggtggttccagctgttggcactttatctgcctatgcagcgactacaggtcctgttgcagataatactagccctcgttccattacactttggaaatatgaagtgaaagatctatctgaactgggtgatcgtggcgatggagaaaaggatgatacagttacaaagtagccgttagcagggatcaaattccgcatacaacgggtaacggcaatcggtgatgctgctttaacgaatccattagatcaaaaagaaggaaccgattatacgattgacaacacatttactgctcaaacagtaacgacaggagcagatgggtctgtcaaagcgaatttgggtagcggcaatgcggcagatggcatttatttagttaccgaattagaagatgaccgtggtgtctctcctgccgttgcaaaaccagcagatccattctttgtgcaagtacctcaaacggaccgtgatgatctaggctcattaatctatgatgtagtcgttcaaccgaagaacattatggaatctttgcttgaaccagataagaccgttgaagaaggaaaaggtttctccaataaagcaggaaatcatttcacttgggaagccaatgccactcttccaagcggactctatcaaattgcagcgaaagacatggttattacaccagtttatgacaaagatggcaatcaagttgcggatattccagtctctgcaggcgacgaaatttacgctgactactatacgattcgcgatacattgaacgaaaagattttgttggatgggttaactgttaatacgaagacagattccagtgactgggtagcacttgaatttggcacagattataccgtcttagactagataagcatcatttccattgtttcgcgcgggaatgtgctatactagatgcttgtaatcgcaccaagaaccggtgcttgaaagaaggagcataagaaatgaaaaatttaaaagttcaagacctgattgctgtcgggatatatacagctatttattttttattgatgagtttttgtctgctgattttacggtttgttattccaggatttcataatttattcattccagccgttacagcacttttttctggggtcatttatctattgatgttgaataaagtaccaaagtttggcgcgatcaccatcatgggcagtgtggtaggtctcttttttttgatttcaggtcactttccgctagcctttatgccgaatattttatgtgcagtactggcagatacgattcagtataaaagcaagtggaaaggaagtctcaagacaactattagttataccgtattcagctttggtttaatgggtcccatcttgccattgtggttcatgaaaaatgcgtatattgattcgctagttgctcgtggaaaagaccaaagctatattgcaggggtctttgctcatacttccacagcgatgctggtgatttgcgggctcgctgtactggttgcttcgattgtcgggataggcctcggtgctcgtctatatcaaaaacatttccaaccaacgttgcatcaaacaaacgggagatcgatgtgactaggctctcacttgaccccagatgcaaattatttgtgacattctttgcaagtgtcacattgatgatttcattgacgtggacaaaagagttgattgtgatcagctttttgtttatcttgtttctacttagcggtttctggcgaaagggattgttgtttttcgggctgtttctattattgtctttggtagaaggtttttttgcagggcaaaacaattcaatagtaaccaccctgctggatttcttttccgtagggtatcgccgattgttaccgacgatcatggcagccgtatttgcgatgagtgggacgaaaatcagtgaatggttagctgctttgcaaaaaatccgcattccctcgtttttgctggtaccgctggccgtactgtttcgattttttccaacattgttgcaagatgtcaaaagtattcgccaagcgatgcgctttcgcggaattgctttgaacggctggtcctatgtaagacatcctctacagacggtggagtattttttgattcctttattgatgtctgcagaaaatactgccacagaattgtcagcgaccgcgttagtaagaggcctgtcggctaaaaatcctcatacatcggtttatacactgcggttgaaacttgctgattatgtagtgtttggtactgtgttactacttatttttttgtttgtaaggatgtgaaggaatgatcaccatcgaaaaactatctcttaaacggggcacccagcaggtattgaaagatgtctcttgtcagatttttgctggtgaagtcgtcgtgttatgcggccaaagcggtagcggtaagtcaaccttgttgaatgttctcaatggcttgattcctgaactatatccagcagaaatgacgggggctgttcaagtggcaggggattctttgccgacggaagactttcccgcctacgccagaaaaatcggtgttgtttttcaaaatcccaaaacacaattttttacaacagatgtttattctgaactggcgtttacaatggaaaatgcagggatagagccagtagaaatacgaaaacggatcaaagaagcggcagaacaattttctttgtcagaattgttggatgcaagtgttttcgaactgtctggtggcgaaaagcagcgagtagcaatcgcttgtgcaacgatgctttctcatgatctctttttgttcgatgaaccttccagtaatcttgatgaagaagcactacaaaaaattgccgcagcgatccgccttttgaaagagcaagggaagacgatcgtcattgcagagcaccgattgtcctacttgacggggattgcggatcgttacttattactagcagaagggcgcttggtcacagagtataccagtgaagcattgctttctcataccccgcaacagattcacaatctcggattaaggcggatcaacgagccgcagttcgagttggcaatcaacgaaacagagggagcgagtttctcagctgatctgattgcgacgaatctccaagtcacttatcgacgccaacagcaaccagctcttgatattgcgaaacttgttgtgcctacgcgacaagtcgtgggtttgattggcccgaacggtgctggcaaatcgacattgtttcaagtgttcgctggcttaaaaaaatgttcagcagctcaattttggctgcatggtcaaccaatcaatcaaaaacagttattgcgagaaagttttctggttatgcaagatgtgaacctgcagcttttttttgaatctgtcgaaaaagaattgttggcaaaagctgccagaccggaacgttttgaacaagtcgtgactttgttggaactagagcatttactgcgaagacatccacaatctttgtccggtggcgaaaagcagcgagtcgcgatcggcagtgcattgctttcaggtaaacgcttgttgtttttcgatgaaccgactagcggattagacctgaaacaaatggaagaggtcggaaatctgctgcaggaagttgccaaagaagtcgatctgttagccgtgatcagtcatgataaagagtttttggatgaaacctgcccttacgtgatccaactcgaacagggaaagttagttgatacctatcagttagcgacaaatgggggataaaagaaaagcggagtgagcattggttcactccgtttttgtctgaacatgaaaaaatcttcatgatctttttctttcaatccgttaggaagtttttacaaaatccgttatgatagaagcaaaaataggaggagagcagatggccttgagaatcttgatagtggaagacgaagaaagtttagccagttttatccagactgagttgacttttgaggggtacgacacggtatgggccaaagatggccaagaggcattgaccttgttcaatcagcaaactgatctgtttgatctgattttgttggattggatgctgccaatctatgatggcatcacggtggcgcggcgaattcgcaaagaaagcgatattccgattttgatgatgacagccagaaatcaaactgccgatgtcgtgactggtcttgacgttggcctagatgattatttaacgaagccctttgaaatcgaagaactgtttgcccggattcgcgtgattgagcgacggttgcagcgggaagcccaacagcaaaagaaccaacaaaatcagttggtggtaggcgagttgatgatggacatcgccaaacacttggtccaggttgccggagagaccattgaattgactcctaaagagtttggaatcttatatgagttgatgaaagaaccagaagtagtcaaaaccagagatgagctattgaatgagatttgggggtatgaatacgatggtcaaacaaatgtggtagatgtttatattcgcacccttcgcaacaagctggatgtctgcggtaaagggaaaatgatcgcaactgttcggggattaggctatgtgttgaggaccgcccatgaagaataagttagccaacccacgcagaaaaactgcccagtttcaattaacgagccgcttttctttgattctatttggtctgttgattctcttcaatgtattgtttatcttgttatccgtagggtatttgtttgaacatatcgaaaatcgtgcgagcaatattcttgaggctatcgaaagcggggaagcttcaggggatgactggaatgatctagtcaatgcctatgtttcggcagatgaagaagatgccttgcaagtgatcttagctgatggcagtgtcattttatcagaagatgcagcagagatttttgccgagatcaatcaaggacggatcatcccatttttggagggcatcgtctttacagatgatggtatctattatacgaaaacccaagaaatcgatagggatcaggtgaagatcgccatcaatggtgaggacagtgtggaattagcctatggtctctttatgatcagcagtttcttgaacctgatcgctgtagtcgttggcagtatattgatttattggagcgttgggaaatggagccggaaattaacagggatggcgcaagaaattgctgaaatcgaacaaagccaaaaaggcgaattgacgattgttgaagaaccaatcgagattcgttctgtggcgttggctttcaataaactactgaaagaacagcgtgagacgatcgcgcgagaaaaacggtttgttgccgatgcttctcatgagctgcggacacctttagccgcgattcgcggacatgtccaattgatccagcggcgtggaaccaaacacccagaagtcattccttcttcactggcctttatcgataaagaatcgaagcgtttggaaacattgagtaatcaactgctggatttggaaaaaaaccaaacccaagaaataagtctcgttgatgtctcgcagatcgtgcgagaagaatgtgaaaaacaagcaacgatcgttccgcaatcgattgaatattttgtggaaaaccagtgtaggaagcaagggcacaaacgtgacttccaacagatcatccaaaatcttttagaaaatgcagcgaagtattcaccagcagatcagcccattcatgtgagactgacacaagatcaaacgcacttgtctctaaccgttgccgactttggtattgggatccccaatgataagaaagcgttgatttttgagcgtttctatcgagtggaagattctcgttccagtcaaatttccggttcaggaatcggattatcactggtaaagcagctggccaacaagtatcatgctgaaattaccgtcacggataatcagccgcaaggcagtgtctttaaaattgatttcccaagtgaaagagaaagatgaagatttttttagattttcttcaagcatttttgattcttttttctgaaggacttgttattctaaatatatagaaaaaaggaatagacaattaattggagaaatgaaacatgaaaaaaacaacaattttgttcggaatcgctgccctaggattattggcaggatgtacacaaaataacactggaaattctgaacctgcacaaaacagcagttcaagctcagcagtcgcatcatcaaatgaaacaacttcttcgcaagctgtggacagatcttcaagcagtgcagccatcgcaaatggcggtttgcctacagtgacagtagaagaagccgtccaagtgttccaaaacaaatatccagatgcagcaatcacatcgcttgacttggatacttcttttggtaagtacttctatcaagttgaaggcgtagacgacacgaatgaatttgaactaaagatcgatgcagaaacaaaagaaacttctgaagaaagaaccgaaaaactagatgcggacgaacaaaacggtgtcaaaaaagaagccgatcaattggatctgaccaacttgctttcattggaagagatttccgatagtgctgtgaaagaagctggcggtggacaagcaacagattgggatcttgataaagaaatgaatgtgacttattgggaagtcaaagttgaagacggcaacaaaaaaacaaatgttaaaatcaatgcgcaaacaggagaaattttagaaattgaacaagatgactagcaaaagcgataagcaataaaaaaagcaaggcagcgaataatgaaacttacgccagtaagcgttctttcgctgtcttgctttttattgatttggctttacttctgtgagaggtttgactcttccgcctatttttgctgcaaaggcttccgactgcttccgatcttcaaaaatccacaacttgtcaggtattttttcacgagtgcgacgaccatctttgccaatgtaaccatgcaagactttaacaacatacattgtcatcatcctcccataaaaattacctttgattatacaaaaaagtgctctaaatgcaattaatctgtctcgagattaatttttcgaggcagccgataatgtcgcataatctgaaaatacttgatggatctcaggaaagctgcgcttcaaatggactaggcgataggtctctttactcaaaaaacaatgtttggaagcgccagttgtgactaactgattgttgtcagttctataaatctcataacgaaaatcaagtcgagtaccggtgtaatgatcgacgagcacatcgatgcgtacttgatcctcataacggatcatttccttgtattgtgcattgacttcaagaacgggaacaatcaaacccgcttcttcgattttatggtatggcaattgtaaaaaggcgagcatatctactcgtgcttcttcgaaccaacggatgtaatttgcatggtgaatgattgccatctgatcggtttcatagtaatgaggttggcggatatagccggaatataaggacatcagggttgctccttttcataactgttttcatcagcataatacaaaacaagagaaatgcaaagtgccttctcttgtttcgggactatttaaattcagcaaacaggtgatcaatcgcttgataatcggttgcggataaatggatatccaatgcctgcgcgttgtcagcaacttgactggcttgttttgcacctggaataactgctgcaactgcaggatttttcatgtaccaagccaacacaagttgaggaatcgttgcatcataagaggcagcgattggtcgcaattggtcgacagccgatacgatttttttaaagcgatcaccttgaaagtccggctttttactacggatatcgtcgtttgaaaaggtcgtttcttgtgtgtactttccagtcaacaacccggatgctagtggaaagtacggaataaaattgattgaatgttcagctaaataagggaaaagttctgattcagcttggcgatggatcaaactgtactcatcttccacaacatcaacgtacccttcggcattggcttcttttaattgttcaagtgtgaagttggagacaccgatcgcacggattttgccagcttctttcagttgatgcaatgcgcgaatcgcttcttctttaggggtggtttcatctggaaaatgaatataaaatatatccagatagttggtttttaagcgtgttaaagcttcttcaacggcttgggtcaggaattccggcgaattatcttttttgtttggttcttctggtcgatgagctgctttagtggcaatgatgacttgattgcgatcgaacgcttcttcttgcaagacatcaccgatcagttcttctgatcgaccttcaccgtaaatataggcagtatcaatcaaattgatcccattgcgcagcgccgtccgcacaatttccttgccttcttcttcatctaaatttggaaataaattgtggccgccgatggcatttgcacctaagccaagggagcgtacatagacttgtgatttgccgatttgaacatctgtcataaagcaattcctccttctaatctcttcttttagtgtaaaggaaaaacttgaaaaacgatattcataagtattgaaaaagcctatgaaacagcttgacatttccaaaggattcttgtagtttatagataatatcaaaaatctgtgaaagatcgagtacgtcattattggaccttcaaagagaaaactgccatggctgcaagcagtttaggacaaatgtcggaaagacaatctggagatgaacagaagaaaagctgttccgtgaacgagcgttaatcgaaaggagaatgaaagttctcgaattttaggtggtaccgcgtgtaataactcgcccttgtgtagaaaacaagggcgagttttttgctgtgaatcactgcgattgccctgcgaagcagggcagagcagatgatgaacagtagtaggcgaccggagggagagtagtcaccgcttttcgaatcactgcgattgacctgcgaagcagggcagagcagatgatgaacagtagtaggcgaccggagggagagtagtcaccgctttccgaatcactgcgactggtcgaagactatgcaagtccttcttagcgtaagcttagaagcgacggtaggcgtaacgcagagtagacgagcagatgatgaacagtagtaggcgaccgaagggagagtagtcaccacttttcgaatcactgcgactggtcgaagactatgcaagtccttcttagcgacagcttagaagcgacggtaggcgtaacgcagagtagacgagcagatgatgaacagaaaatcgtttcccacaatggatcaaatcagtatagttgtaatgaatacatacgatcgtttttgatcgatcgaagatacccacaataggaggatgaaaacagatgagttatcaacgtccaaaaggcaccaatgatattttaccaggagaatccgaaaaatggcagtttgttgaagaaacagcccgtttggtttttcgtgattaccagtacaatgaaatccgcacaccgatttttgaacattttgaagtgattgctagaagcgttggtgatacaaccgacatcgtttcaaaagaaatgtacgatttctatgacaaaggagagcgccatgtgacattgcgtccggaaggcacagcgccgattgctcgttcttatgttgaaaataaacttttcggacctgaatacaacaagccttacaaagtcttttatattggaccgatgttccgctatgaacggccgcaaaaaggtcgcttacgtcaattccatcaaatcggtgtagaagcatttggttccgcaaatcctgcgacagatgttgaaacgatggcgatggcgatggatttctttaaacaattagggctaagtcaacttcgattagtgattaactctttaggggataaagaaacgcgtaagaactatcgtcaagcactgattgattatttatcgcctcatgaagcagaattaagtgaagattcaaaacgtcgtctgcatgagaatccactgcgggttttagatagtaaagacaaacgagatcaacagttcgttgcggatgctccttcgatcttggactatttaagtccggaagctaaagcccattttgaaacagtcatcacgatgttggatgctttggacattccttatgagattgattcaaatatggtccggggactggattattatacccatactatttttgagattatgagtgaagcgccaaaaatgggggcgcaagctacgatctgtgcgggtggacgctatgaccatctggtcgaagaattaggcggcccacaaacgccaggtttcggttttgcgatgggcttagaacgtctattgatcacaatggaagcagaagaagtcgttattccagcattgaacgaattagatgcttatgttgttggtctaggagaagcaaccaatttggaagcattgaaagtcgttcaggcgatccgtaattttggcttttcggcagatcgtgattttatgaatcggaaagcaaaagcgcagttcaaatcggcagataagcaaggggcgcgtttggtgctgaccctaggtgaaaatgaattagctgaacaagtgatcaacatcaaatcgatggcaagccggatcgagaaacaatttaagttagccgatctgtatgatcattttgatgaaatctatgatgaaatgactacaatcttaatcaagcaaggagaagaagaatgagcaaacgtacagtatattgtgggcgcgtctcagaagcccatttagatcaaaccgttactttaaaaggctgggtccaaaaacgtcgtgacttaggcggagtgattttcattgatttgcgggacagagaagggatcgtgcaagttgtctttaatccggaagtatccaaagaagcatgggcgattgcagatacttgccgcagcgagtatgtgctagaagtgacaggtcaagtcatcaatcgagcaccggaagcaatcaatcctaagatgaaaaccgggcactatgaagtgatggtcagcgagatcactattttgaatacagccaaaacacctgcattttcgatcgaagatgatcaaatcgtaggagacgaaacgcggttgaaatatcgttatttggatttacgccgtcccaaaatgactaagaatatcatgatgcgggcaaaaacgacacaagtgattcgtcatttcttggataccaatgactttctagatatcgaaaccccttatttagcgaaatcaacaccagaaggcgccagagattatctcgttccttcccgggtttaccctggtcatttttatgcattgccacaatcgccacaaattttcaaacaattattgatgggtgctggattcgatcgttactatcaaatcgtccgttgcttccgggatgaagacttgcggggagaccgtcagcctgaatttacccaagtcgatattgaaacaacctttttgacggcggaagagattcaagcttacacggaggaactgttagtcaatgtcatgcgtgaagtcaaagggctagaagtaactacgccgtttctgcgaatgacttacgatgatgccatggcacgttatggcagcgacaagccagatactcggtttgacatggaattgattgatttgtccgaaaccgttaaagatgttgatttcaaagttttccaaatggcgcttgaaaatggcggtgtggtgaaagcattgaatgcgaaaggtgctgcggataaatattcccgaaaagatatggataatttgggacattacgcaggacagtttggtgcgaaagggttagcatgggtcaaagtagaagaagatggcttaaaaggaccaatcgcaaaattcttgactgacgctgcagcatcgatcattgctgctacgaatgcagaagtgggcgatatcctaatgtttggtgcggataagtttgagatcgtttcggcggctttaggagcaatccgcagcaagttaggaaaagaattaggcttgatcgatgaaagcaagttcaatttcttatgggtaacagattggccacaatttgaatacgatgcagaagctggccgctatgtctctgctcaccatccatttacgatgcctaaagaaaaagatgtaccattgttggcaactgatcctgcaaaagtgtatgcggaagcttatgatatcgtcttgaacggttacgagcttggcggtgggtctctccggatccatcagcgggatgttcaagaacaaatgtttgaaacccttggtttttctcgccgtgaaatggaagaacaatttggtttcttgctgacggcattagactatgggttcccaccacatggcggaatcgcactaggcttggatcgtttagtgatgttgctggctggtgaagaaaacatccgtgaagtgatcgcattccctaaaaacgggaaagccgccgatccaatgtcacaagcgccaagtaaagtggcgccgctgcaattgttcgaattgaatattgatgtcacgacagttgaagaagactaagtaaaaagaaatgaacaagtaaagaacaaacgagcgaatgatgaatgaaaatagacgattaagaaaattccatgagaatttgtctatttctttcattgttcgtttctttttttactatctgaagtataataagagcaaatcaacaaagcgaggctcttgaatgaaatgaataccctctttaaatggctgccacaccctgattatgccaacaaattatcgttttcgatcgtctacgccattttatcggcgatcgcagtcaattttttttatcaacccggcaaaatctattctagcgggatcacagggatagctcaaattttgaccaccgtttccacggattggcttggattctatatccccgtctcagtcgccctattgttgctgaatattccgcttttctttctcggctggttcaagattggtcataaatttacgattttcacaggaattactgtagtcctaacatctttgttcgtacagattcttccagaagaaacactgacgacagatccgatgatctgtgggatttttgggggagccatcaacggagccggtattggttatgcgctaaaaagcggactttcctctggcggcctcgattttgtaagtatcgcgatccggaaacgtacggggaaaaccatcgggtccatctcgatttttttcaatattgccatcatgtttgctgcgggcatcctgttcggctggcagtatgcgctatatagtgccattgcgatttttgtcagtggtaaagtcaccgatgctgtttttaccaagcaaaagaaaatgcaggtaacgattattacgagaattcctgaagaagtcatccatacgatccagaaaagtctgcgccgaggaattacgatcatcaatgaagcagaaggagcctacaagcatgataaacagacagtattattgactgtcgttacacgcttcgagttgccgatgttacgttctgccatgaaagaagcagatcccaaggcatttgtcagtattgctgaaaatgtacaaatattgggtcgtttttatgaagaagaattataggagagcttggatcaaagcgtttcgtgatgaaatgcttttttctttttgtaaaaattaatttttttagaaaatagagtattcttgctagctttcttgttgctttatctggtaaattatgaagaaatgggtcattattttttaatggttccacattgactgtttcttacgaaaacagttgatcaaaaaaaagaaaagtggttggagaatgaacaaacggttaaaaacaagccgctatatcactggtttcgacggtatccgtacattagccgtgatcggcgttatcttatatcatttattacctactcaaatgcgaggcgggtatttaggagttcctgttttttttgtagtttctggttatttgatcaccgatttgcttcgacaggagtgggaccagaacggtcgtattgctgtcaaagatttttatgtccgccggatgaaacgactgtatcctggcatggtggtgatgctgcttctgtctgctgcctatattacattgttccagcggaatttactgaataatctgcggggagtcgtcgtcagcagtctcttgtatgtcaacaactggtggcagatcaatcacggtctttcttattttgaccgattcggcaatgaatctccctttacgcatctatggtctttggctgttgaaggacagaattatttgatttggccgttactctttattttattgatgaagttagtcaaaaatcgtgggacgatttttaaaatcgtgatcggctgctcgttactttcggctcttttattagcgatctggtattcaccaggggcagaccctactcgagtttattatggtaccgacacgcgtttgttttcgatttggatgggaagtgcgctggctttcatttggcccagcacccatttaaaaaaagaaattccgaagaaagcgaagcgggtattgaacctagctggtggtctttcttttattggtttagtgataacattttttgtgctagatgatcatctttcctttgtttattacggaggaatgctgctagtcagcttgctttgtacgatcttggtggcggtcactgcccatcctggagctagtctgaaccgttggctgacaaatccgttattcagttacatcggcaagcggagttatgggatttatttgtatcagttccctgtgatgattttttatgaagcaaagattgggaatgtcggcgaaaatgttctcctgcatacattgattgagattgtattgattctcttgatcagtgaattgtcctatcggtttatcgaaaatccgttgcggaaattccactacaaagatactttccgcacggtgcgcaattggtttagtaaaccagtgatcagtcgacaaaaaccttggctgcttccaggactgcttgtttccttagttgctctttatggaatagctaccgctccggtgaattatgtagatgcgcaacagcagcagttaaaagaaaatattgctgccaataaaaaagcggcagaacagacacaaaaaaatgcgaatggctcggatacagaaagtacaggagacaattcttcaaaggcaacggaagccgaacaatcagtaatggaaaaatatgggttgacagaagcccaggtgaagaaggctgaagagctggaaattaccgcttttggtgattctgttatgctggatgccactgccgacttgcaagaaatttttcccaaagctgtcgttgatggggatgtgggacgacaattgtatgagagtccggaactgatcaaagcgttgaaagaaaaagatttgttacgagatacggtattgatcggtctaggaacgaatgggtcctttacagaaacccaattcgataatttgatgaaagaaattggcgatcgcaaagtctattggatcaatgtgcgggtacctacgcaaagatggcaaaatgaggtcaacagcatgctggagaaaatggctgctaaatacgacaatatgacattgatcgattggtatgatttaagtaatgaacatgaagagtggttctatgaagatcgagttcatccaaatcctgatggtatgttgcaatattgtacactagtttctcaagctattttgcaataatggcgttgactatttcttagaaaaataaactaaccgagaggtctcaagcacagattcttgtttatcttcaagaatcgcaagagatctctcggttttttgtatcgcctttcctaagtggaatgaggatctttatccaatcgttgcaacaagcgtttcaaacaacaatgcactggaagcggcacctggatcgatatgtccgattgcccgctcgcctaaataagaagcacggccttttttagcgactaggtcttttgtatgttctttggcttcctcgatttgttctttagtcagactgccgttttttaacgctgcggcaacaggttgccagacatcgaccatcgttttgtcttcgaattctgctttgcctcgagctttgatcccattaagcccttcttcgatgatgcttcctaattgttcatacgaatcaattgtttctagttcttttgtagctttggtcatgttcatgaatgctgagccataaagtggacctgaagcaccaccaactttagagatcaatgccatcgagagtactttgaatgtgtctgtgattgttttaggctgttgttttgcgaatgcttcttgataggctgcgacgccgcgagccatattgttgccgtgatcgccgtcaccaataggggtatctagatcacttaaatagcctttattttcctcaatggcttttgtaaatgcatttaaccattgttgggtcatctctgttgtcatttgcattgaaaattcctcctttaccaagcaatcgtttcaacaggttcgttgagcgcatccgtcgcatcgttgttactgaaatcgatcatggtcaatgatagaccttgcatatcgatagaggtcatatagttgccgactttatggaatgtgacagaaatgtctttgtctgcgagcaatttctgtacatcgttggcaaagacgaattgttccatcagcggtgtaccacccatgccgttgatcaagacaccaacttttttcggtgtttgttcataatcagctaaaattttgtccaccaattccttggctagctctttcgatggtttcaatttttcccggcgataaccaggttctccatggattcccacgccatactcgatttcatcatctgctaattcaaaaccaggtttacccacttctggaacggttgctgcttttaaggcaacaccaatggttttgatggtcggaactaatgcttcacctaattcttttaattcagttaatgaacgtccttgacgagcaaaagcacccaaaatcttatgaacgagaatggttccagccacgcctcgttttccagcagtataggtactgttctcgacggcaatatcatcatctacgacgacgatttcagcagtgatgtcttccatctcagccatatctttggccatttcaaagtttaggatatctcccgtatagtttttaacgatcaaaagcacgccttgcccttgatcggcttctttgatcccagtcaggatctgatctggtgttggagaagtgaagacgtctcccaagacggcggcactcaacataccatcaccaacaaacccagcgtgtgccggttcgtgtccgctgcctccgcctgagactaagccaacttgttcgtgggtggtgttttttgctacgactcgggagtcttcgacttgatgaaccagttgcggatagctggcaaccagaccagctagcatttcttcgacgatcgctgaaggatcattgattatttttttcattattgtttccatcctttctcagctgctttttgggcttctgctgtgatctgggataggtcatcactgaatccagcggtgattgctgcggcaaaagcaccttctacaagcggtgcatcaatcaagtgatagcgggtttgctgttccggttccaacatatcataggctagctctgcgtttagtacggcactacccaaatcagcaaaaacgagaatctgttcggcatccggagactgattgaccgcttcaacgatttttgtcggatcagaccctaattcgccttcagctgttccacccaatgaaaaaagagtgactgtttcgctgtccgacatgtcttcgatcatggctttcagtccgtctgtcagttgttgactgtgagaaacaagtaaaatacttttcttcatttcgattcaccaacgctttcttaaatagattcagcggcagtagacgaaaccgccttcactaaaagtataacaaatttcgcaaaacttgcatggatgacgattgagagggggcaaaacaaacaacaagctaaatttgtttttaacgatcaacaacaactcgtgaaagaggaattgagcaacggtaagaagatcaatcgattaaatagttgtttataaatagaaaattactcctatgcatcttttctttttgcctaaattttatagggatttaaaaaaagtacttgcatttgagtttgttaccgattacaatccaagtgtaatcattattttgttattcaatgtacaaaaaaatgtatattgggaatggaggatttctatgaaaaaaattgttattggcggtcagattgataaaaatgaagtgaaggacttggtagaaaaatttagtgaggggcaatttgaaattgacattaaaagtgacttagatgcggctatggcagtaaagtctgggcaggcagattattatgtaggtgcttgtaatactggtggaggcggggcattagcaatggctttagcactattaggaagagaaaattgtgtaactgtttcaatgccgggaaatgtaatgcctgaagcagaaatccgtgagaatgtacaatcaggtaaaactgcctttggctttacagctcagcataaagaaacggttataccgatcatcatggatgagttgaaaaaaactataatctagcggaggaaagaagatggattcatcaaaaattattgagttagttgcaatcgcgttgttaggtggaatatgtgcagtgttggcaaataaaggtatcgcagtatttaacgatggattacgaccaattgttcctgaatttttagaaggaaagattgggaaaaaagaaattgctgctacgagctttgcattgagttttggtctagttattggttttggtattccagtatccatcggggcatctattttactggttcatagtgttttattaatgacggatatcatcggatcctgggcgccagaaggcaagtctggtatcatcatttcggcaattataggcgctatgtatggaattggtcttgttctaggattgcaggcggtagttgatttatttgcaatgatgcccgtgaatttcatggattctttgtctatggtagggacaccagttgttatttcttttagcatttttccagctgtcgcaattgctagtcagcatggatttaaaaaaggagctatttcttttgcagccacattattaactttatttgcagtgaagcgctttggtacgtttgatttaggtaatggaacttccttaacactgagtgcggagggaatgtcattactggttggtatgattttcatgattgtgtacgccattcaggtcaaaagtgatggaagcaactcaaatgaaagtcttgtcagtgtttttttagaacgtgttaaccgtattaaaaaaaattgggcatggttagcagtgaccggtggcttagtctcagcagcaactagtttaatgattattgccggagatccaatttctttaaatttactttcggaaggaaaatttagtgaggctggattagctgccttcgctcgaggcattggatttattccgttggtgttttcaactgcaatcgtaacgggagtttatagtccagctggtacgacctttgtatttgtagctggtattttattgcatgataatccaataatggcttttatcgtaggttcagctttaatgtttattgaagtacaattgttgagtttgatggcaaaagccctggataagtttccgggtattcgtgaaatgggtgagcatattcgaacggcaatgaataaggttttagaagtagcactactgattgggggcgctatggcatctgaacaaattgcgccgggaatcggttatttctgggtcattggtttaatgttattgaatagaaaagcgaagaaaccagtggttgaattggctgttggtccaattgcggcaattagtttaggtgtaattgtaaacatcctttatctggttggattatttgcaccagttgtagcgaactaggaggtagctgtacatgattcttgaaggtatcacatatatgcatgaacacacaacgattgatttatctcgattaaaaaagagtgatgatacaaatttaaattgctttgatgaaactgtttcagaatacaaaaatttgtacgataaaggtgttcgaaatatcgttgatgtaacgaatcttgatatgcgaagaaatcctttatatgttcaaaaagtggctgaacaaactggaataaatattattcaggcaacaggtttttatcaggataaatttttacctagctttgtgacagaagcatcgattgatcaattgtcctcattaatgatcaaagaaatcgaagaaggaattgcggaaacaacgatcaaagcagggattataggggaaatcggtacgagcaaggacaggatgacagatcgagaacgaaaaatatttaccgctgctgtcattgcccaacaacagactaagatcccgattacgacacatacaacattaggcacatacgggcatgagcaggtagcttttttcaaggaacaacaggcggatttgtcaaaaatagttatcggccatgttgatctaagtggcagcacagactatattctaaaaatgctagacgaaggtgtttatgttgaatttgatacgatcggaaaagaaaactatcagccagatttattaagaattgaaatgctgaaagaaatagagaaacgtggctatcaagataaagtcttcctttcaatggatatcacgcgtaaatcaaatctgtcttatcaaggtggtatagggtattcttatcttttggatacctttgttccgatggctttagaaaatggtgtttctcagacatttattgaccgaatgctacgaataaatcccaaaaaatttatggatgattaggagatattgatcatgaaagcttatcctttaaccagtctaacggtgacagaagcacaacaattacaatttaagcttgttgatgccattacacgaattgtacctggggatgaactattaacaagaggggatcttggtgtagtaaaaggactaaatcaaccaaaaactacctaccagattgagcaagtattggctaatttttttgaatcagaacaagctatgctcgttcgcggatctggtacaaatgctattcgactagccctccatgctgcagtaggaactggtaaaacgttgttagtgcatgatgcccccatttatcctactacgaaagtttcaattgagatgttgggaatccagacaattcatgctgactttaatgatcagacgagtgtgacacaggccttaaatgaaaggcaagttgatggagttctaatccaagtcacgaggcaaaaaatttcagattcatatgacttagcacaactgattgccactattcgtagggtgaatccactaattccaattattacagatgataattatgcggctttaaagacaaaagctataggttctcaattaggtggcaccttagcctgtttttcaacatttaaattgcttggtccggaaggtattggatgcattgttggtgagaaagaatacattagtaaattacgagaagaaaattattctggtggtggacaggtacaagggcatgaggcattggatgtagttaaaggaatgatttatgcaccagtagctttagcaatctccgctgaggtaagtgaagcagtttgtagaagaatcaacgaaggcgaaatcgcagaatttaaaaaagcctatattgtcaatgcgcaatctaaagttgttgtagtaaaattaaaggaaccaatagcacaggcgattattacagaagcaaccaagttaggggctttgcctcatccagtcggtgcagagtcacaatacgagtttgcacctttagtttatcgcgtttcgggtaccttcaagcaatctgatccagaagctgagacaacaatgatccgaataaacccgaatcgatctggcacggataccattatgcgtatcttgcaagcatctgtaaaacgagcctcaagataaggagaaatcatgggggaagagtttttaaagaaaaaaggaattgtcattaactttctagcatccgatcttttacaattaaaaaaaggggatcgtgtacctagtgttagcgaatatcagactcgcttcgatgttgcgagagggacgatccaaaatgcgctaacctttctaaaagagataaaggcagttcaattaaaaagtcatgggcatttaggaacctttattgaagccattgattatggagtattacaagaatacgctttatcggatacgattttaggaacaatgacgttaccctattcacgattgtatgaagggctagcaacaggaatttacgaagtctttaaagagaataatatcaaacttaatatggcatacattcgaggttccaaagaaagaatccgctcaattacaaataaaacgtatcgttttgcagttgtttcagcatttgctgctcaacgagcaattaaacaaggagagcctttagaaatagttgttaattttgggacacagacatatttaagcgagcacgtcttgttgtttaaagaagagggacaaactgttcttacatcaggtatgagaattgccatcgactacagctcattagatcaacaggcactaacaaaggaaataattggtgacttacctgtagaatttattgagatgcaaggacatcaaatcatctctgcgcttaaggatgatcacattgatgctgggatatggaactttgatgaaattagggataaaaatcagcaagggttacagtatgtgtccttaaaagaaaatcagttagaaaaagcgatggggacttcggtaatcattacgcatattgaagatgtttcaatgaaagccttcctacaaaaaagcatcaataaagagaaagtactgcaaattcaacaagcagtttgccaaggacaattaattccgcaatattagtaagggggcttattcatgataagagataaattaactgttttattagattcggggattgttgatcaggaaacgtacgattatgtatttaacgttttatcctatttattagaaaaagaaattgttgaagaagagcaacaagctgatgtttttttgacccacttagcgatggcagatatgcgaagaaaaaataatgaaactgtcaacagcttagagtctttcatccaagcagagattgaaggtgatccgcattatcttcattctagagaattgtggcaagacttacaaaaaatgacaagtgaacagtcattcgcggatgcggagttagattatttttatctgcatatcattaatatgttaagggaggagtaatatgttcttagatgtaacgatgcgcaaaaatccgcagttagtagaagccggattaagattgcatcaaacaggacaaattcttccagatacgtatgtgctagatcttgatgctatcgaaaacaatactcggcttttagtggaaagcgctacaaaaaatcaaatcgaactgttctttatgacaaaacagtttgggcgaaacccttatgtcgcacagaaaattcatgaggcaggtattaaaaaagttgtggtggtggattacaaggaagctttagtgatgatgaaacaaggcttgcctttagggaatgtcggtcatcttgtgcaaattcccaaacacttgctaaagaaaattatggattatggtacagactatatcactgttttttcaactgaaatgatcaataatatcgcgactgttgccagggagttaggaatccagcaaaaaatactactcaaagtgattgaaccaggcgacgaaatttatgagggacaatttggaggatttcatctaaatgaattaacgaaggtcattgaaatagtaaaacaggaaggaattatcgttggggggattacttcctttccttgttttctttttgatggcgtttctgagttacaaccaacgcacaatgttgaaacaattaagaaagcaataaccattcttaaacaggctggtttcgcaataaaagaagtaaatatgccttctgctacttgtagtcgaacaattccttttatccatgagttaggagggacacaaggggaaccggggcatgctttaacagggacgacccccttacatgctcaactagaattgccagaaaaaccagcaatattgtatgtcagcgagatttctcataacttagatggtcacggttatttttatgggggcggttattatcggcgagggcatttagaaagcgtaatgatttctactgacgaccagaagctagcaaaagatgaagttataccttttggtaatgatagtattgattattatctttcaactaaactcccacatgaagttggtgcaacagtacttgcggcatttcgcactcaaatatttgttactagaagtgatgttgctgtagtgtcagggattcaaactggacaacctagaattgaaggaatatatgacagtcttggaaaacaaattagaaggtgagaatatggggagatttgtcgttattgtattagatagttttggtgttggtgctatgaatgatgtacaggaggtacggccacgtgatattggcagtacgacagctggacatattattcgagacataccgaatattcaaataccaaccttggaaaaattaggcttaatgaatgctttaggggaggaaattggacgtcatcatttttctaaaacagcaaattatggaacgagtaatttggctcactatggtgcggattcttttttaggacatcaggaaattatgggaacgacaccaaaaatccctttgattcagccattcaaccaaaagattgatgtagtggaagagaatttagtgaaacaagggtatcaagtgcggcgagttggtgagaaagggactcaaatcttagtggtcaacgaggtggcaacagtcggcgataacttggaaactgattatggacaagtctataatgtatcggcttgtctggatttagttgattttactaacttaaaaaaaataggacaagcggttagagacgttgttcaagtctctcgtgtgatcacttttggtggagaacagattgttttagatgacttattatcagccaaaaaagtgaaaaatgatgagattgctggagtggatgctcctgaatcaggtgtttacaatcatggctatcaagtcgttcacttggggtatgggattgacaaaaatgtccaaacaccgaccatcttggataaagcaggaatcacggtatctttcctaggaaaaattgctgatattattcaaacggaaagtcatcgactatttcccggggttgattctgaaggattgtttgataatttgatgagtgaagtaaaaacaattgatcacggatttattgctttgaatattcaagaaaccgatttagcggggcatgcggaggatactgagaagtatgcagatcgtttggaagtaagtgatcgtagaattggcgaattgttacttgagatgcgagaaggagatctattgattgtgatggctgatcatggcaatgacccaacgattggacacagcaatcatactcgtgagcgcgtcccgctattaatttatagcccgggggtgcaagggaaaaaaattggtgagcggctgaccttagcggatgtaggagcaacggttgctgactattttaaggtggcagcaccacaaaatggtgactcctttttaaaagaaatttttgattgataaaaaagacttgggtgcttgttttcataaaaagctatgccaagtcttttttaggaaggaggtataaggatgcatgaaagggtacaaaagtatgcgctaaaaactagtttgggcatgttaaatccaagtggttcagtagtaactgtttatcccaatgcgatcaagcagatcaatacactcaatgactattatctaggagtgaagcaagtatcatttatgttgactgactttttaacgtttttatcaagcaacggatttcatcaacacacattagacaaagcaagttttagcggcagagggattgatcttgatttgaagaaccccattactggtcgctttatgtcaggatcatctagtggcacagcattgaatgtttttctaggaatcaacgatgttggattgggcactgatgggggcggatccgttctagctcctgcgtctgccttaaatttggtaggatttatccatcctgatcttggaaatcaatttgttgatctatctgtaaatagaaaaacatcaacggataatatttcatttacaccctcgctagggtttattagtaaaaagctctcactgattgaacagctttgtcacctttgcttaccccaaatgtttaagcagacacctaaaagaagggtagtggtcgataatagaattgacgtgaagatgcgccaagaactttctaatatttctaccatcgaatgcatgtacaaaacctttgaagatgcaacgaccttttctcgagaaacattgattcaacagttacaggcaatgctcattgatttcgatgtgattgttgtcaaagaaggacccattgacttgtttggcatcggggatactgttttcggtcattttgatgaacggacaatgggaatacaacagcaagcaggaaaagggtatattcgggttgtgaatatgtgtcaagcagtagggttagttgttccaagcagtgaattagcgactagctatctattgatttgtaaaaaagagaataatcttgagcctctatttaccttagccaaagcactcctatgcaaaatggatcccttgattgagacctattttgctgatagtcaaaagtattttgaacatggatatcaaagttgaagaactgaaattgctagtcgccttttctactaaggaaagacagaaagttaataaagattttatgagcggaaacaacaaaaatccgaacaaccgttgataagtatcttaatcaggagaagggatcatcgttgttcggatttattttattgaaaggatcaagccgtagcgttttgctctagccggcgggtgatctgtgttgcaagggcagatagcccccactgcaataagcagttgatcgccatcaatccaacaaagattggcaaggtgatgctagtcaaaaagcctacttctaaaatgtgatggaagagcattgcggcgatgtatgttccgctaatcgtggttacgatcaaaaataagcgcaatggatttagcggcaaacagctgcggatcacagctaaacaactgatgccgatcagcagataatagaacaatgtagttgcggtcattggttcccagccatagtcagtttgcaggaactgtacagcgaaataattcagaagcaccaagagtgcgctcggcaacgctcgcagcaatgcggtaggcaagtaacggccggtgattcgctttttgtcttcttcaaaggaaaggaagaaggaaggatatccttcaattgctaggtccaataatgtgatttggatcggaataaaaggaaatgccgtagaagtggcaacacatagtaaggacaataggaaactgtagatcgttttgataaaaaagatcccagatactttcgtcacattattaacgacacggcgaccttcaaagagtgctgctggcagtgtcgtaaaatcggaatctaataaaaccagattcgcgattttacgagccgcactgtccccagcagccatagcgatactgacatcggcttcacgcagtgccaacacgtcattgacgccgtctccagtcatggcgaccgtattgcctagtgccttcaactcagaaactagcagtttcttttgctgaggcgtcactcgcccaaaaacggtataggtttgggcagcttgacgaacgtctgcttcttcagttagttgggaaagatcgatatagttctctgaattaggcaatccggcgcgtttggcgatggctgcaacagtgatcggattgtcacccgagatcactttcaagtccactccttctgcagacaggtaggccaatgtgctttctgcattttcccgaatcacatcagcaagaacaagaactgccagcggggcagcctttgctggatcaaagggctgattggcgtcgttataatgaggatcaagagtcaagacgaggactcttaaaccagccgattgcgcttcttgaatttgcggcagctgttggttggcgatcgtcttttcaggtgctcctagatagactgcccctaattcgtgaaatgcgatagcaccccattttcgatcagaagaaaacggcatcgctgcaaaggactggtaatgatcagatccggtgatggtttggcgcaacgcttgcatcgtcacattgttgtcggtactggcagccaaataactacctaagattgccgttatatcttgggtgtcatcgattggctggatcgattcgacggataatcgaccttccgttaatgtgccggttttgtctaaacagagggtatcgacatgggccagtgtctcgatcgcgtacatatcttggactaagatcctttttttggctagtttgatgacacccgtggtcaaagcaatgctgatcaataggacgagtcctttaggcagcattcccaataaagcagcagacgaaacgatcactgcttcttttaagtcactaccacgaaataaataagcttgtagaaataggatcacccctaatggaacaatcactagactggtgaattttgtgactttgcgaatcgaagaaactagctctgaacgcagcggtttatgtgttttggcttcattgcttaattttgccgcataattctctgctcctacgcggatcacttttgcagtgacctctccactggcgacaaaactgccagataagagagtcgcgtcgttttctttgacgacgagatcggcttcgcctgtcagcatcgactcattgacatcggcttgtccagataaaaccaccatgtcggctggaatctgttctcctgcaccaatgacaacaagatcatcaaggaccagggatttggcatccaccgactgtgtaacgccatctcgtatcacacgtatttcttgttgggcgatgatcgagagttttttgactagatttcgagcatggatctcttgactgatccctacagtgatattgatcaaaatgattaccagataaaataaattggaataggcgccaactgccagaagacagacaccaatcaacaagttcagcaaattgaacaatgtgaggatattgtccttaaaaattgctgtcgtagacttcgatgtttttgtttcataatcgttgtgttggtcttgttcggttcgttgtgtgacttcttctgaggtaagtcccgtatctatttgcttcatataattctccatttctatcagattccttgtttagtctagcatgccaagaagtcattgcaagaaatgatgaaaaaataattgaaatcttaaaaaacagtagcggtttgttcgaaagaaggggcttttcattgacttgttcccagaaacttgatatagtcataatgctcaaatagtaatgatttcgatttgttgtttttgaatcgaaaatggaggactctgctagctgatttcttttctttttagaatgatggatagaaaaaacaaaggagaaaataatggccaaaaaatcaaaacaagcaaaagcaaaaaaacaagcctcaatgatcgagcaatacgcagagatccgttaccaattgaaacaagcaaaagattaccaagctttagcaaaattgcctaaagattctaatccgaatcgcttgaagaatcgggatatgactgatggtcgtccacggggctatatgcgtaaatttggtctttcacggatcacttttcgacaattggcacatgaaggcaaattgccaggtgtaaaaaaagctagttggtaaacatttaataggtgtaacaaaaataatacaatcaaacgatctcccttctagatagctcagaaatgcgctgtatggaggggtattcaaggaaaactatctgaatgctgaggcagctgatctcctaaaaagactgggagatagacgccgagcgtttaggtagttttttgtttgaattttttgagggcagcgattcgactaatcggaagtggtctcgtataatagaaaaagcaaagacgaaggtctgatgaacacatgttggataggagtatatcatgtctttaaaagagaaaatcatcgcagaaagcaagcgtttaggtattgataaaatcggctttgcttctgctgaaccgttttatgaattagagtcctcgttgagggagcagcgcgcgaaaggccatacatctggtttcgaacatcaagtgatcgaagagcggatatatccagaaagaacctttgaaaatccgcaaacaatcattgcgatcgctctggcatatccgacaaaaatcaaagagaaagtgccgcgagatgagaaacgggggatgtttgcccgcgcctcttgggggatcgattaccatgatattttacgtgatcgcttagaaaaattgatccagtttatcaaagcgcaagcagagaatctggaagaagcagaaagctggcggtttgccccgcaagtggataccggtgagctggtggatgtggcagttgcacagcgtgctggtttggggtttattggccgcaatggcttattgatcacggaagaatttggttcttttgtttatttaggcgagatcgtcaccaatatttccttcgaaacagatgaagcggtaccctttggctgtggggattgtatgcgctgtgttactgcctgtcctacaaaagcgctcttaggggatgggcgaatgaacgcacagtgctgcctttcctatcagacacaaacaaaaggcatgatgcctgaggaatatcgtaaaaagatgcataatgtcatctatggctgtgatatttgtcagttggtctgtccctacaatcgaggcaaggatttccattttcatcaggaaatggaaccggaagtagaaaccgtttatcctaagttgcagccaatgctttctttatcaaataaagcttttaagaatcagtttgggcatttatctggttcttggcgcgggaagaaaccattgcagcgtaatgcgatcattgccttagcaaatctgggagatcgcaccgcattgccagccatctggcggtgtgcgacagaagacgtccgacctgtcatccgtggaacagcctattgggccattggacaattaggcatcaaagaacccgaacaatggctagaacgcttacagcaatgcgaagaactagaaccagaagaagaagcacgcgttgaactacaagcggcgatcgaacgcttaaaaacgatcgtggcatcctccggtgcagatcggaaaaacaagtcagttgattgattgcgtgctaggcggaactccataagcacgtgagcaatcgtacaaaaaattaaagcacgcgattttttataataaagagccgagcaatgtttagaatacgtcaactatgccgcaaatgcgacatgacctgaaaagtctggaagtattccgacattgctcggctattggtcgaatggatgctatttttaggggaagatttttcacagtagtctattttttcagcttaatccagcacatcatcgctttcaacgatttcttctgagtctaattcaaagtctggtgctggatggacacgttccggtaattccatctctagttcagctgtttgttggtattcgttgtcgctatcagcaacgtcaatcaatatatccgttggcagttcttgatcgattcgatagccttgtgcatggcgcgcatcgagtagttctaagaggtgctgccattcatctttggcaatcaccacgacatcgattccttcttgattttgaatttcgacaacagaagatagatcagtcccaacagtctgaatgatttcttctaatgaccattttacgttttctaatgaaattttttgtgccatttggatacccctttcttgtcaattgactctcatttcattgtagcgggaatttggttgattgcaaaatagtatgatcgcaggtctatgaaaggggttaaaaaaatgagaagaagaattgaagtcttttgtgaacaaaggtaatatggtattaaaagaaatgagggagtaaagatgaaagaaaaacaaacgtttcatgttaacggttacttagcactgatcgtcttgatcgccttaatgatcggcggcggctatctcttttatgatgggattgtccgcaatgcggtttgggagttagtcatcagtgtcgtgttgtggatcatcgctatcttgttcattagttcattgacgattgtgcagccgaatcaagcgaaagcgattcttttctttggtcaatatttaggtaccattaaagacaatggactctttgtgactgtgccgctaacacagaaaatcaatgtatcactgaaagtccgtaacttcaatagctctttattgaaggtcaatgattctgatggcaatccgatcgaaatctcagcagtcgtcgtctttcgagtcgtagatacggccaaagcattgttcgatgtcgattactaccaagattttgttgagatccaaagtgaaacagcgattcgccatatcgctacccagtatccttatgacacttttaatgatgatgatttgactttgcgaggcaataccaatgaagtttctgaagaactggcacaagaactgcaagagcgtttagcggtagccggtgtcgaggtgatcgagacgcggttgaatcacttggcgtatgccactgagatcgctagtgccatgttgcagcgtcagcaagccaaagcaattttatcggcacgacaaatcattgttgaaggagcggtctccatgacacaaatggccttggaacagatcgaagatggccaggatattaactttactgacgatcgaaaagtccaattgatcaacaatttactcgtatcgatcattactgacaaaggcactcaacctgtgatcaatacaggcgatgtgaaagaaaaggcggtgtaatcaaatgaaaaaactttacatcaagcaaaaagtcttcagtatcggtgaaaaatttactgtcatggatgagcagcaaaagccgcgctattttgtcgaagggagtttcatgaagattcctaaaagctttgcgatttatgatgaacgacaacagcaaatcggtgaagtcacaaagaaagtgtttagtctattgcccaagttttttgttgaggtacatggagaagaagcaattgttctagaaaaagaattcacgcttttcaaagcgcgttattccatccatgcccaaggaattgaaattcaggggaattggtgggacatggactttgtcgtcaatcgacagggacgtcaaattgctgagattcataaacgatggatctcatggggggatacctatgaagtaacggtttatgaggaagatctggaggacttgattatttgtctcgtcattgccatcgatcgcgtaaaagccgatgatggtgcagctgcgagttctgccagtacttaaacagaaaatgaaagcaacgatggaaaaggagacgaaaagatgtacggatcgatagaagcaggcggtacaaaatttgtttgtgcgattggtgatgaagaaatgaccattaaagaacgggtcagttttcccaccaccacaccagaagaaacaatggcattagtgatcgattttttcaaaaagtatgaagaccagttagtggggatcggtattggttcctttggcccaatcgatatccatcgagattccgcaacgtatggctacattacctccacacccaaattagcttggcagaattttgattttgtaggtacgatgaaacaagcctttcccatccccattgcttggaccacagatgtcaatgctgcagcttatggggaatatgttttcggtaaaggaaaaggactatccagtgtagtttattatacgatcggcaccggtgttggcggcggtgcattacaagatggccgctttgttgagggattcagccatccggagatgggacatatgctggtagtgcctcatcctgatgattcattcgaaggcagctgtccatttcatggcaactgtctcgaagggatggccgcaggtccagcgattgaaaaacgcttaggaaagaaaggacaggaactgtctgaagatgagcctttctggagcatcgaagctgaatatatcgcgcaatgcgcctacaacactacattgatgctttcaccggatgtcattatttttggtggtggcgtaatgaagcagcgtcacatggtggaaaaggttcatcaagcttttgaacgattggtcaacggctatgtcaaaacaccagcagttgcagactacatcgtgacacctgaattagaagacaatgcaggaacattaggctgtctggcactagcacgagaagctgtgttacattcctgatacatgtgatcacaccaaaacattggtgtgatttttttgtgattgaagggattatttggcaggtaagagcagaatgcgtatacttaagcagaggtggaaagagatgaaaattgcagttcgtaaaagaaaaatcgggaatatcccagtattggaagtcgttccagaacatttgatctatgaaccgttgccgttgatcatttattatcatggttggcaaacgagtaaagaattggtactgacgcaaggtcgaaaactagcacgggaaaactttcgtgtgattttacctgatgccgccaatcatggcgaacgaaagacccaactatccgagattccttcattgattttctggcaaagcattcataccaacttatttgagttttcttatttggtggatttctttgaaaatctaggcttggtaaataggcaaatcgctgtaggaggcgtttcaatgggagggatgacgacttgcggcttgctatgtcaacacccggagatcaccgctgctgcgtgtgtgatgggctcgccatcgatgatcggttaccgtgaacggatccagaaacatgcgggtgctgcaggtttctttgtcccagatgactatcagttgctactgggatggatcgaagcttatgatctccagacgcaaccagaaaaactagctggacgtccattgttgttctggcatgggacggaagatgagaaaataccttacgccgatgtagaaacctttgtgcaagggaatccagaagcgaatctgacatttatctctcgcgaagaacgacatttagttcgtggagagaccatggatcaggtaacggccttttttgttgaacaattaggaaaaagcactgattcactctgacaacaaaaaacgacaggtatctaggtaagcaaagggattgtgtggttatgtacaagcataaaattcgtgttcttcatttttcttttttatactgtagggtggaaaaaaggaggaatgactgtgaactatcgcgttttattattttataaatacacgaccatcgaagatccagaaagttttgcgaaagagcatttagcttttgggaaagagatcggtatcaaaggtcgaattcttgttgcgaaagaaggaatcaacggaacgctttctggaacgattgaagcaacggatgcctatatggaaaaaatggaagcggacccccgtttcaaaggaatctactacaaaatcgatgaggtggaagaacacgcctttaaaaaattgtttgttcgaccgcgaaaagaattggtgtcattgaacttagaagatgatatcgatcctttagaactaaccggaaagtatctagaaccgaaagatttcaaagaagcgttgttggatgaaaataccgtagtgatcgatgcgcggaatgattatgaatacgatcttggtcattttcgaggtgcggtccgtcccgatatccgcagtttccgtgaattgcctcaatggatcattgagaacaaagagaaattcatggataaaaaagtggtcacttactgcacaggtgggattcgctgcgagaaattctcgggctggttgttgcgagaaggattccaagacgtagcacaacttcacgggggaatttttgcttatggcaatgatccagaagttcaaggagagttgtgggacggtaagatgtatgtctttgatgaacgtatcagtgttgagatcaatcatgtcgacaagaccgtgatcggtcgcgattggttcgatggcacaccatgtgagcgttacgtcaattgtgcaaatccagagtgcaatcgtcagttcctcacttcggaagagaatcaagcggcacacttaggcggctgctgctatgaatgtgccgccaatgaaaacaatcgttacgtcattgagcacaatatctctcaagaagaacaagcagcagttttagcacaactagcgtctgaagtgacggtttaaaaagatcctgaaaaggatctttttttgttctttaattatctgaaaaatcaaacgattccaattgatttttttaacaaatttcactttaaaaaaggcaagctcctcgcatatttgtttgatttggagtaaactatacctaattgtcagataggaaagaggaatagagatgaaaattgttattgctggtgctggtgccatgggcagccgatttgccattaaattaaaaagaggcggcaacgatgtaacgttgatcgatggttggccagcgcatatcgaagcgatccgtaccaatggactacaagcaaatttggatggagaagaaatcacagaatctttccccatttatccacagtccgaagtaacggcggatacgccagcggatctgatcattgtttttacaaaagcgatgcaattagaccaaatgatgcaagacattgcttcactaatcggtgatcaaacaagagtactttgcttacttaatggcattggacatgaagatacaattgaaaaatatgtcgctaccgataaaattttcttaggaaataccctatggacagcagatttgattggacctgggcaagttcgattgtttggggaaggatcggttgaactgcaaaacattggtgaaggcaaagaagcagcggccaaagaactggctgaggtactaactgcttctggattgaatgcgtcatactctgaaaatattcgctattcaatctatcgtaaagcctgtgtcaatggtacattgaatggtttatgttcaattttggatgtcaacattgcacagtttggaaatacagccactgcacgacaaatggtgcaaaccattgttggagaattcgcagctgttgcggctcatgaatcggtagaactagatgttccagaagtcgttgcccatattgaaaaaacctatgatcctgcaggtattggcttacactatccttccatgtatcaagatttgatcaataatcatcgtaaaacggagatcgattacatcaacggggctatttcgcgtaaaggtcgaaaatacaatgttcccacgccttattgcgacttcttgacccaattgatccatgccaaagaagatgtgcttgaagcgaagtagtagtaaaaataaaaaactatgatataagtctaataataaaagatccgaatcatctatgtaatgccctggtagtttaggagaacatcgtcacacattttggacgttcaggagcaatcaaacatttatggtccggatccttttttttgttcatatcgtagtgactttaattcaattgacgataaagaatttttcctgctattgcttattacaaattttacttgtgattaattaactttttttgaaaagtgacggtattgagtaggagtcatctgcattttgttttgaaagagcttgaataaggagggcgtactcttgtaacctaaattttcagcgatagtatcaatagtcatggaagattctctaagtaatctttgtgcttcaatcaaacgtttttggtcgatcatttcttgaaaagtcgcgccagtttttgtcttgagcatattacctaaatagttttggttataaccaaactccgtggctaattttttgagagtgatagttgtgtaatgatcgttaatatattttaagagtgcagctaaatcatttctttgagaagttaacgacagttcattcaaactaggaattgctgctaattccaataaacatgatcctaaaaggagacttaaggaacgatgatagaagatttctttgagataaaatttgtgaatcatcaagaataaaagctgattgatgatcgcgtgttcttttaaatcaaaaactaaaaaagtattatgaacactatcctttttagcagcattcaaaaagaagtccgtgactggattacttgaagcgggcaagtggttcaagagctctgtttgtaaagtatgtttgtcaattaaaatattgagaatcaaatcatcttttcctacataatcaatttgctgaatcacttcagtgtccataataatcaattgctgttcagtgaacctccatgcctccccgtttattttttgccgacaacatcctcttagaaggtaattcatttcaatgaaactatgagtatgagcaggcgtataagagtagcgatgatgcttattgatataaatagatccctcttcaaaaaaatcattaacgggtatttttggaattactgatccatgatagtctaaattcatttcattaatattcttcccagtagttctttgctgggcttcaattcgatcttctatatcaaaaagtttaatcaaactttccatccgtcaatcacctaatttttttatatagttagttctatatataagttattcccaataaatagtcaatatttactttgctattaaagggtttgtcagatcaaacaaatagcctttcaaaaaaattcaaatttatgacctgtgaatttgatagtaaagacctacatttttgaaattgtaccattttatgtaagcgtttaatataaccctatgaacaagaaagggtgtttcaaatggacacaaatggaaagcagcaatcattagtgaaaaagtattctcttttagcaactgcagccggtgtaggttctatgttgggttctggatgtatcgtcggtctctcggcaactataccggtttggcaaaaagggttgaacttatctgcgggacaagttggattaatctctggtgcactaacctttgcaattgcgttcggctctttgtttgcagggcaaattacaaaaatcttcggcctgattcgagcgttcaactggatcaatttgttttatgctattggagcagcaatttgtgtattttcaggaaattttgtggctttattattaggagtcatcgtcatggggattgcatctggggcggatttaccaatcagtttaaccgttgtctctcatgatgcaccagatgaaaaaacttctgcaagtttagtatcttcgacacaaatattttggcaaattggtatttttatttcttatatttgttctttcttactttccggagtcaatggagttttgggagcgcgtattgtttttgttattttattggtcttttcaatctttgcgtgggtttggcggacagtctcaaaaaaatttcggatgttccacgaagaaggtgcagcacgtcagtctgcgttgaatctggttagcaatcaacaaaaaatttcactaaaagagatttttagtgggaataatgcaaaaatttatcgcaactttttcttcgctattttagtcttttatgtttgttggaatttgttagcgaatacatggggacaatttcagacatacgctttgactaatgctggtgctacacaaatgcaagcaacagggctaggtattgtgctgaatatcatttctttagtgactacgattatctttgcttcagtagcgggtggaaagcatcggaataaagcattttttgttggcgcttttgttcaattcatggcaatggttggtatggcagttattggcggtagtgcaggattcatcgcattggcgataacgattgctttttataattttggaaatccattagcaggggaagccatctataaagtttggactcaagaatcatttccaacagaatctcgggcattcttacaaggcattatcaatggtttttcacggttgtgttgcggattgtttgcctttgtcacaccatttttggtatcgccaaacaatattcaattttcgatgtatggctttgcggcgattgttctagtagcagctattgcaggagctgtcatgatgaaattgcaaaaaggagctaaaacgagagcaaacagtcgaagagattctaatctagctgatttagtaaagtagttgatcgatagaatataaatgagtaaacgaaaggaacggataatagtgataacaaatgaacggccacgatggatctggtatgctggcgattttgaaatacgtcaaggacttttacaaaatttttctagagaagaacgaggatacgattggccagcttactggtatattgatgactgccataaaaatgtaaaatttaaacgtgaatatgaattacaaagtcccacgacatttgttgtatatgcaacagggattggctttgtagaagtgaatgaagtgaaatattcttttgaacaagagattgtctgtcaacccggttttaataagattagggtgaatgtagggaatccaaacggtttgccagccatctatattgaaggagaaagaatcaagagtgatgaaggctggtattgcagtaactttgttgaagaagctccagtaggatggagcaatctttatatgaataaagagcaagaccctaataaagtctattatgaaatagaaacttgtttccctgtttcgaagacggcggttgctggcggcacgttgtttgattatggacggacgattttcggttcattaatgatcgataaattgttgtcggagataccgatatctatttgctatggagaatcagaagcagaagcatgtgatagtcaaatgtgttattacaaacaggaaaatgtaagaaaagaaacaaacattcgcaaacgtgcttttcgttatcttttcattcctaatatagcaccagaagcaattgatattcgtgcgatgcatgaatatcttcccttacacaatcaagccacattcaaatcagatgactctgtgatgaatcgaatatgggatatatctatagaaacctttacattgtgcagtgggcttttctttattgacggaatcaaacgagatcgctggatctggtcaggggatgcttaccaaagctattttatcaaccaatacttattctttgatgaagatatcaataagcgaacgatcatggcattgcgaggtcaaaatgaagtaaaacagcatatgaatacaattgttgattattccattttatggatcatagggattgaaaatcactatatgatgtctggggacagctcatttcttgcacagatttattcgaaaatggtgactatgatggactatcttgaaaaacaaacccatgagttaggatttatttatggtcgcgaaaaggactggatttttattgattggtctgaaatggataaggaagggacattggcagcggaacaagtcctgttattgaaagcatacaaagctatgactgtttgtggctctatcttgaatcgtgatattgatcactatgtgacaagatatgaacagttgaaagctaatttaatgagttatttctgggatgaagaaaaaggggcatttattgattcttatctatctggaaagagaaatgtgacacgccatgccaatatttttgcggtcttattcgactttgtagatgaaacgaaaaagcaacaaattttgaaaaatgtattgcttaatgatgaagtcactcaaatcacaactccttacttcaaattcttcgaacaagatgccctttgtaaactgggacagacaagtcaagtacatgagattattcttgactactggggtggaatggtggaacaagaagcggttactttctgggaggagtatattcctggagaaagtggaaatgctatttatgaaatgtatggggatccttttgggaaaagtttatgtcatgcatggggagccagtcctatctacttattaggacgttatttcgcaggaattcaacctattcgaccaggttatgaaacattcttagttgaccctaagctcgattcttttcatcaattaacgtgtatattcccagttaaaggtggctgggtgaagattgagaagacagatacgtgcttaacaatttgtacaaatcgagacggtgggatcttgcggatagatggaaaagagcagccaatgtttgccaatcaacctgtaagttatgaggttgtaaaaaaggtctaagctggattcatcaaagaaaggaagaaagcaatgaatagtgatcggttaaaagtgtctgaaaaactcggatttgccttaacaaatctagggaatatccctattatgacactattaaatacgtatttgttaattttctatacggatgtcattggtgttaatccagctttggtaggaatgttattccttgtttcgagacttttagatggcgttagtgatccacttattggttttgtgattgatcgttttccaagaacaaagatagggaaatacaaacctgtgttgattttaggagtcatcatctgttgcttaaactatttgcttgtttggttttcgcctctcctatttccagctcaaaaaatcattgctattagtatttcttacatccttctaggaattacttttgattttatggatattcctttgaatagtttaatccccgtactgacgcaagaggatgaagggcgtaatcaactttcatcaatcaaagggatttcatatacggtaggtccagctatcttaaatgtagcagcacctttggcaatcgcagcttttgcaacgtctttgaaaggatacgttttattgattgtagggacggtactagttgttctattttttacgattgtagggacgttgatggtaaaggaaagagggacggaagctgcctatgtaacaaagccggtaaaagaaaaatatacaatgaaggatgcgttatctgtattcaaactgcgtccagttgtttcattgtttctagcaatgctattcattacagcggcaacgaacatcttcaatggttcacttctatattatcttagttatattattagcaaccctaaattattgagtgcagccagtttcttaggtatgctgggggcattggcagcagggcttctggttccaaaattatcgcagcgatatggaaaaaaacatctgtacattacaggtttggtattgatttcattatgtatgctgggatttctggtcatcaatcatcactcagccgttttcgttttatgctattgcggggtgcaatttgcattagggttgacgaatacactgcaatacagtatttcggccgataatgttgatacgataagaaacgaattagacatagaggcgacagcattgattgcttctctcacttcattaatcatgaaatttgcgatggctataggtggtgctgttccgggatttgtgttaagttttaccggctatgcagcgaatcagtcaaaatcaagcactgcggaaaaagggattttattcgtgactttcgttatcccgctgattttatatgtagtgacgatcgctgtgttcagcagtggttttaaaagtaacaaaattaaaagtttgcatgtgcaaaaacgaaaaacaatgaactaagagcgaagtagcattttcattaaaacgatcttaaagcgagaaaaatctatcttgaagatggaaagaaataaatccattctccggatagattttttctgctattgttattcgactagctatacggatgcttcgcaggaagaagtttttgtttacagtatcctccctcaaccttcaggcaaatctgccatgtatctttcggttccttgaaagacggccaattgttctacaccgaaggagcacagcatctggctcatttcggcaaataacaagcgataatcactggacttatgcgcatctgaacctagtgtaaagagtttgccccccacactttgatagagcgggatcgcatattcgtaaagtgatgcattttgataaggaccaaagcttttggcattgacttcaaaagctagctcgcgagcgacgactttcttgaaaataactgtcagttctttttcgaaatgctgtgcaagttcttctgctgtaaagtcgaagcgccgcaacccgtagtcaaaatgggtcaggatatgtccgtcagaaaaagtatctaaaactgtggccatctgatcaaaataagacttgacgacggtaagtttgtctttctccaatacggcatcatccatatagtcaaaggaaccgttttgatggatgctgactaacttcaggtcataaggatgctgatccagatagtcgcgtatttgtgtttcttgcccaggaacgacaccgatttcgatccctttcaaaagtttcgttgctgtttgttcctgtaaagtctgatggcattgttgaagctgttcataatcgggaatatcatcgcgataatttgaataagggttcttgagatcaaagtggtcagtcgccacaaaaaattccggttgaaaagctaaataattttcgaagcgttcttctgaatcaaaagataaaaaagtatgcaaatgctgatcgtagtaattcataataacctcctttttgtacaagataccataaaaagcgagaaacgactattttttcataaaaaatcagaaaagcatttcgtacaaaaattctttgttctataatggatgagaatggaagcaaaggagtaaatagcagtatgagtatgtatcttgagattccggaatttgaaagcgattttcgctttcggacattccttaatgatgggctgacgatcgtttatccccatgtacataaagaaatcgagctgatttatgcgaaacgaggaaaagtcaatattggggtagctgatgagatcattgagttggaagaaggcgagctgtacatttttgccagtggccagccccactattttttggcttctccagagagtgagcgttatgtgtatcagtttgatttcgcactgtttgatgaaaccattttgcgagaaaaagaactttctttaaaaacactttttgacgagggggaaccccacagcaagcattggccagtcagttttaccgaaaaaatcacaggattgttgatcgaactctaccagttagaggaagagcaagtagctggtaaacgctatttgactatgggttttttgtatcagttgatcggcgaatgttatcaagggttgccgccgcgtgccaaaaagatcgctcctttaaaacgttctgcagctcaatacaaagaaacgctgcaacgtctggatgaagtgtttgaatatattgaatcccattaccaagatgtcttaacgatggaagaaacagcgaagcatgttggattcagtccccattactttacccgcttttttaagacgaatactggaaaaacattcatgcagtttctgacggaataccggatcaatcaagccaaattcattttggcaaacgagaaacttccaatggcagaagtagcggaaaaagccggatttgccagtgtcaaaacgttccatcacgtgttcaaagagaccgtaggacaatccccattgcagtatcagaaacaattaaataattgaatacttgatgaaagctagatcaacgagccaatcttgtcaatcactcgaacccttgaacaagcgcaatttttaagcgattgttcactgtttgtttgggtgcttttatttggtgtgaaggagtctttgattcgttttagtgagagttccataagataaatttcgggaattttttaagaggaaattgggaagaacctgtcaaatcctttcgctataatgaatgagtagaaaataataagcgttttcaggaggaaagagatgacagtaagaattggaatcattggttgcggtgggattgcgaatggcaaacacatgccggcattatcacaagtaaaagaagcggaaatggtcgcattttgtgatttgatcgtcgaacgagcagtggaagctaaaacagctttcggtacagaagatgcccaggtattcagcgactacaaagaaatgttagcagaagctgaattagatgttgtgcatgtttgtacaccaaatgcttctcacgcggaattgtccatcgcagcattagaagcagattgccatgtaatgtgcgaaaaaccaatggcaaaaacgacagaagaagcaaaagcaatgatcgatgccgctaatcgaacaggcaaaaaattaacgatcggttatcaaaatcgttttagaaaagattcccgctacttgcacgaggtttgtgcggaaggacaattaggcaatatctattttgggaaagcccatgccatccgtcgtcgtgcagtaccaacttggggtgtctttctagacgaagaagctcaaggcgggggaccattgatcgacatcggtacgcatgctcttgatttaacattgtggatgatgaataactaccaacctaaatttgttgtcggaaaagcttaccatgaattatctcagacaaagaatgcggcgaacgcttgggggtcatgggatccagagaagttttcggtagaagactctgcttttggatttgtcgtgatggaaaatggcgcaacgattttcttggaagctagctgggcgttgaacagtttagatgtcaaagaagcaaaaacaacattgatgggcagcaaagctggcgcggatatgaataatggcttaacaatcaatggcgaagatcatagtttgttgtatgaaaaaaatattgagttggaaactggtggtgtcgacttctatgaaggggacggcgaaacgcctgaaatcttggaagcacaatcttggatcaacgccatcatcaatgacacagaacctgtggtcaagccggaagaggcaatggtagttactgagattttagaagcaatctacaaatcctcagcaactggcgaaccggtctacttgtaaaagcagtcgctaaaaaggagcaaagcatgaaaccaaaaatcggactacagttatggagcatccaagaagcgtgtaaagaagacttgttccaagcacttgaaagtgtcaaaaaaagcgggtatgacggagtcgaattcgcgggttactacggttattccgcaacagaggtctcaaacgcgctaaaagaatacgacttgggagttgctgcttctcatctaccctttgaaacattgcgggatcattttgaagcaacactggcctatgaaaaagcgatcgggaatcaccgactcgtggttccatatgcttcatttgagacattcgcagaatggcaacagtttgcccgagagtttgcagaagttgctaagaaagcagctgctcagggctttgaatgctactatcacaatcatgcccatgaatttaccgagattcctaataaatcaatgattgaagaattgttagctgaaaatccagcacttaaattagaagcagatctttattggatcgcttattccggcactgatgttttcacttggttgaaagaacatcaagagtccgttggtcttttgcatatcaaagatatgcaggaagaaccaaaagaaagcacagaaatcaataatggcattttacctatcaaggactatgtcacagttgcgcaacaattccaattgccttggttgatcgtggaacaagaagcgttccaaaaatacgcacctttagaagcgacggccatcgattatttgcaattaaaagctatcgttgaggaggtttaccaatgatccatgtcactgtttggaatgaatttagacacgaaaaaacagatgaaaccgttcaggcaatgtatcccgaaggaatccacggacaaatcgctgcctttttgcaagcagatgattttcaagttcgcacagcaaccttggatgaaccagaacacggattaacaaacgaagtattagctgataccgatgtgctcgtttggtgggggcatatggcccatgatgaagtacaagacgaaatcgttcagcgcgttcaacaacgggtgttagaaggaatgggtctgattgtcctccattctggtcacttctcaaaagtcttcaagaaattgatgggcacttcctgtgacttgaaatggcgcgtggatgatcagcattgtcgaatttggaatatcaacccgagtcatccaatcgtagaaggtgtcggcgaatttattgaacttgagaaagaagaaatgtatggggaacactttgacatcccaactccagacgaattgatctttgttagctggttcccaggaggcgaagtcttccgcagcggctgcaccttccgtcgtggcaatggcaagatcttttatttccaacctgggcatgagacgtttccgagttattacaacgaaaaagtacaaaaagttatcaaaaacgcggcacgttggtgcgcaccaacagaaaatacgtacccaacgtacggccattatcaagccaatgaggaggtaggcaaatgaaattaggagtatttacgccattattcaatcatttaacgtttgaagaaatgatcacagaagttgcagaaaaaggattgcagacagttgagatcggtacaggaggttctccaggcaatgcccacttggatatcgataagttgcttgctagtgaagcagaccggaaagaatatttagctaaattagccgacaaaggactagaaatctcggcgttaagctgtcacaacaatcccatttcgcctttaaaaaatgaagcgcaggaagcagatgaattattacgcaaaacgatcaagctggccagtttgatgaatgtccctgtcgtcaatggattctctggtgtttcgggaggaaatgcaacagacacgcaagtcaactggcctgttctgccatggccaacggaatacgatgataattacaactatcaatgggagcaaaagctgatcccttattggaaagaaatcaataccgaggcagaagctgctggtgtaaaaatcggtattgagctgcatggcggattcttggctcatacgccttatacgatgttaaaacttcgcgacgctgcaggtaaagcaattggttgtaaccttgatccaagccatttgtggtggcaagggatcgatccagtggcagcagtcaagattttaggtgaagcagatgcgattcatcattttcatgccaaagatacgtatcttgatcaagataatatcaacatgcatgggttgacagacatgcagccatacagcaatgtcaaaacaagagcttggactttccgctctgttggctgcgggcacagcttgcaagtttggtcggacatcatttccgcattgcggatctatgggtatgattatgtcttgagtatcgagcatgaagatccaatcatgtctgttgatgaaggattgaaccgagcaatcactaatttgaaatcgattatgatcaaagaagaaccatccgcaatgtggtgggtgtaacgaggagtatagaaaatgagtgcaatcaattttgttgtcatcggttatggcggtatgggtgcttaccatgtgcacaacatcctgccgaatgaaaatgaacggatccatattgtgggaacctatgatatttcggaagaaagacaagctatttcacaagaaaaagggcataaaatctataaaagttatgaagaagtcttagcagatgaaaccattgaagcagtgctgatcgcaacgccgaatgatttgcataaggatttgtcgatcgcagccctcagagcgggtaagcatgttgtatgtgagaaacctgttgctttaaacactgctgaactagacgaaatcgttgctgtggccaaagaaacaggcaatacatttatggtccatcaaaaccgtcgctgggatccagactttctgatcgttcgcgatttatatcgtaataggcagatcggtgatcttttccaaatcgaatcacgggtccaaggtgcaaatggcatcccaggtgattggcgccatgtgaaaaaacaaggaggcggcatggtattagactggggcgttcacttgttggatcaaatactttggttagtggacagtccagtgaaagatgtgaaagctgacttaagctatattctgggagaagaagtcgacgatggattctttgctttgatcacatttgaaaatggtgtcaaagcaatcgtggaagttgggacctccaattacacccaattgcctcgctggtacattaagggaattgaaggaactgctacgatccaagattgggcgttgaatggtaagatggttcgggcaactggccgcgaagatgttgccgcacctaaacctgtccaagcaggtgttggattaacgaaaacaatggcaccgccatctgaattggctgcagaatcaatcccatttccagaagcgaaagccgattttgatcctttctacaagaatttttatcatgtagtccgtcacggtgctgaaccaattgtcaaaaatgaagaagttcgcaacgtcatggaattgatcgaacgaatctttgccgtagccagcgcaaaataagagcaatcaagacacagaaaaacgaatcccgccatagcaaatgatccctgttaaatcttgcagtcaaaggagagttaacagagatcatcaagtgatgcaggtgattgtttgcctgtgtctttttttattccgaaatataaaaattgaaaagcagatcctgcgggtaattgccccaacgatcgccaaaaatagttagaccgccagcgttttctgcggttgccggtgctgcaattttgaatgtaaagaaatcactgtgatccaaatcgatctcgcttaagttatggtcggtcagcttttctccgtcgatcgaagtatcaaaacggttgatccgcagatgtttcaacaagccgtattgactgaactcatcgatccaccattgaggggtcaatgccccccgtacatctgaaaagtttcctggaacagtataggttcctaaacagacatcgttgatatagaaagaaatatcactcggccaataattattggaaatagggaattcagaagcaatctccatgctgatttccagcatttcgattttttccccattttttagcggtttcggaattttgtactctaagaatccattgtttaaccagataatactggcatctactcgttcttgtgccaaaaaggatttaggatcatccaatgcgccgatcaggcgatcttttgtagccattccacaagaagcttcggctctaaaatcagtgaagtgaccaattttcacaggtaatgaagtcaaattcatttctggaaatactttttcggggaagttgatgttgatgaaatcagtctttaaagctagaaacttctttttccaatcttttcccgttcctttttctaatctgatcaattgtgcctgctctaattttttgatgtgcttggtcatgagtgcgttgctgattgccagtttttccccaatctcactgatgctttttctttccccgcctaactctctcaaaattgccaaacgcgtctcattggctaaagcttcataaaccggtaaagaggttttctctaaatttaattccattctattcacctcgttatacttttttgttaattgattgcgcaggtttattataacataacttgatgattttacactatagttaaacgatataaatattttattttagttgttaaatagctgttgacagcgctttattttgatgttaatttaacggtgtaaacagtttggtttttattgttgttgaaaaaagtaaagtgagttggaatatcgttttacaaataagttaaataataggagcgtggaaaaatgaaatttagtaaagcagctatagtagtaggggcgacgttgctgtgtggcatcgtattgtcagcatgtggaagtggcggcggcaactcaagcaagagttctgaaattttgttatggtcatccacaactggaccagatggggagaaaatcaaaaagacgattgacgaatacaatgcgacggatccggatttcaaagtgaaattagtgagtatgcaaggggataccttcacctcaaaactaactacagcaggtaaatcggggaaaggtgtaccagatttggctttagtcgcttcagaagcacttcccacctataagaaccaagagatgctggattcttgggatgacatgatcaaaggtacagagctagatcgcagcaattatgttgaagcagcttgggataccggtactcttgaggacagccagtatgggattcctgccaccatggggtcgtgggtcatgtattacaacaaagatctggtagacaaatacattcctggagcattagatgatggcatcgtgacttatgaagaaatcaatcaggcaggtgaaaaagcaaaagcagatggcgtttatagctttggttatacctgggggatgcagaattattccaatctatatcagcaaatgggcggacaatggcaagatcaagatggcaaaatcaatatcgataatgagtattcgtataacacggtacaggaattcaaaaatttgtatgatgcgggctacatggtgccagacggggaagatgccaataaactttttgcgaatcaacagttgatcttcttgccggaaggaacgtggatgttgagcaatatggaagaaatcagtgactttgagtggggagaaacctttacaccgcaatgggatgcggaaaatatcgttcaaggatcgggagttgatcagtttgcgatgtttaagacaaaagaagaacgctctgatgaaaagaaagagggaatggtggatttcttgacttggttgcaggcaaaccagttagaatgggtgaaatctggcgccaatccaacttcactagcgatgcttgacaatgaggaatatgtcaagatgccgcaatctttcttgttgaaaacagaaaaaggacaggcggcgatctctgtgaatgcagtcgatggattgtcttacatttttgatgaatacgacaatcgttcttgggacatgatcactggaaaagccgatattaaagatacctttggtgaaatccaaaaagtcgtggaagagaaaatgaaataatcgcagggtctgtgacaaaagctgaaggcaaagaagatagtgatcaggcatgtcgagaagacacataccaaaagaggactcatataagatttctcaaagagtggccttttgatctggttagcttggcaacttacacgaaagagcatcttccatgcagaagtggtttttgtcacagtctttttctagtcgattttatcaaggcatgaaaggatgcgtaatgtatgagtagcaaaaaaaagctcagtggttggcccgttttgtttatcggtccccacatgattctttttattttattctttttggttcctgctgtaattggtgtttatgtttcctttaccgaatgggatctttttagttcaccgatttttattggtttagacaattttaagacgattctatttgatcaagactcgctgtatcatacgcaatttttcaatgggatgaaaaacacgctattctttgcagtgatatcagtacctctgtgtatcgcgattccattgctattagctgtggcattgtccgcaaagccaaagatgatgcgcttttttcaatcggttctttacttgccgacattgtttgccatctctgctgtaatgatcatctgggggtttctgttaagtaaatcctttggccccatcaaagaagtttttgggatagatatcaattttgtcgggacacaaccatgggcctggatcgcgattttgatcgtaacgatttggtggacattaggaggaaatttgatcatttatgtagctgcgttgaacggtgtgcccagggaacaaatggaggcagccgagcttgacggagccagcagtgtagtgaagtttttccggatttcgttgccgagtattcggaatcagctgatttttacaacagtcatgacgactattgctcaattcaatatttatggacagccattgatgctgaccgggggtggtccgaacaattcgacgagagtactcatgatgtatattcaagagaatgcttttggcagtagtacgtccgttgctggtatgtcatcggcgatggcgattttactagggatcgttatcatgatcgtttcggtctttcaatttatcatgatcaaaaaattagagaggtaaggggacagccatgcgagaaaataaagtaggaaaaagagtcgcatttatcgtattagctattgtttgtattgtctggatttttcctctgatatgggctatttttacctctttcaaatcagatgctgagatccaaaaagttggctttagcctgattcctaaagagtggactttcgcaaactttttagggttgttgcaggggaatgattcatcgccagtctttcgctggtttttgaattcgatgatcatttcaacagcccacacattgttggtgatggtgatcgtttcttttgcggcttatggctatacacggctgacgtttaaaggtcgagacttgatttttgcattattgctgggaacgatgatgtttcctggtgtcgtcaatttgatccccaatttcaaaatcgtggatacattaggctggaccaacacatttctagccgtgatcgttcctggcgcagcaggtgtctataacatttttctagttcgtcagtttatcttagggattcctaaagaattggatgagtcggctgtaattgatggggccaatgaatttcagattttttatcatattattctgccgctgatcaagccggttttaaccgtcgttgcgttatttagttttactggttcgtggaacgacttcttgtggccttctatcgttatgagcgatattgataaactgcctatcacgccgggacttcagttgctgcaagggcaatatatgacgtatccgggagtaggagctgcaggagctcttttagcattgatcccgacattccttttatatttagtggcgcaaaagagtttcatggaatcaatgtcattgcaaagtggtataaaataaattgttttttggaggaactatgagcagaaatgaataccctagaccccagtttcaacgagaaaactggctgaatttaaatggagaatggcacttcgcctttgatgataaaaatgtaggactaaaagagaaatggtatcaagaggaggaagcctatccgcatagaatcaaggtgcccttcgtctatcaaagcgaattgagcgggatcaaccaacgagaacctcacgatattgtctggtattaccggacattcacagtgcaggcaatggacagtcaacgtgtagtcttgcattttggtgcggtggattacgaggcggatgtctttgtcaatggttgtcatgtaacgaatcatcaaggcggtcatacctcttttgaagtagatattaccgattatttggtcgacggtcagcaagcgataagtgtgcgtgcatttgatcctcatgcagatgaaagtattcctcgaggaaaacaattctgggagacagaatctgctggtatctggtatacgaattctaccgggatttggcagccagtatggctggaagtcgtttcagagacttatttgaaagaaatcaatctaactccaaattttgatgaggggaccgtgactgttgaaacgatcttgaatcagttccagccgcagtgtgaactggactatcggatctcttttaaagaacagctaatcgcagcggggagactgtctgcagattcggcaaaaatgaagttcaatgccgatctttttcaggaacatattttcagaagcaatttccatcatgacggttggtcttggacaccggaaaatccccagttatttgatattaaactttctttaatcaacgatggagaaacaattgactacctgaaaagttatttcggcatgcgtaaaatccatacggaaaacggcatggtctatttgaacaacaaaccttactatcaaaagttgattttggatcaagggtactggcctagtggcctcttgactgcaccgtcagatgaagactttaaaaaagacatcttactagcaaaagaaatgggcttcaatggttgccgcaaacatcaaaaaacagaagatccgcgctttttgtactgggcggatcagttaggttttctggtttggggagaatgtgcggctccggcgatttacaatgaagattctgttgaacgactgatgcgggaatggaccgagatcattgccagagactttagccatccctccattgtgacttgggtgccgatcaatgaaagctggggcgtgccaaagatttcctttgaccgaacacagcaacatttctctcaagcaatgtatcatttcttgcacgcattggataaaacacgattagtgatctcaaatgatggttgggcaatgacagaaacagatatttgcgccattcacaactatgcccatggccaaaaagaagaaactgagaaatatgattactttaaagaaaccctccgaactcgcgaaaatctgattaagcggctttctactccgtggccgatttttgccaacggcttttcttatcaggagcaaccaatcttgttaacggaatttggtggcatcggctttgatgtatcgggacaaccaggttgggggtatacgtcagtcgacaatgaagttgaattcttaaaggactaccaacgggtgctgtcggctgtctatgcttcagtagggctctggggatattgctatacgcaattgaccgatgtcgaacaggagatcaatgggttgttgacttatgaccgtcagcctaaagtggacttggcagcaatcaaagctatcaatgatcaatttcatgtttctcaagttgaatgatatgcagacggcaacattggaaaggagagacaatgagaaaaaatggtattatttgtgcattgattttggcgactcctttcgtaggaggttgcggtacttctcatgaaacgctggttgacgatttcacagcgatcatcgacaacgatggtgcagacccgtggatttttcaagatgagaaatattattattatacgaaaactactggtaacaacttaaccctttggcgttcggaaaatctgactgaagtagcagcgggggagaaaaaagtcatctgggaaatgcctgcggagtttgaaagtatctgggcaccggaacttcatcagctggatggtacgtgggtcgtttattttgcggccaatcatccctcagaaacccaccggatgtatgcactagtcaacgaaaaccaggatccttacagtgatgattggcagttggaagaaatcaaaggactggatgacaagtttgctattgatggaactgtcctcgaattagacgaacaacggtatttcctttggtcaggttgggaaggatatgaaaatattgcccaaaatatttatattgctgaaatgatctcacctacagaagtcattggtgaaaagcagctgatttcgactccggaatacgaatgggaaatgcggcaaacgccgttgattaacgaagcacctcaagtgatcatcaaagaagatacggtaaatgtggtctattcggctagtggaagttgggacaatgattatgcactgggacttttgacaatggatcgccaagatgatccattagatacccgaagttggacgaaagaatccgaaccgatttttcagcagacagaaactgtttttggtcccgggcacaatgggtttgccaagtcgaaagacggcaccgaagactggttgatatttcacgctgctcgttgggatcattctggctggcaacgctcgattcgtttgcagccaatcaaatgggaagaaaacaagctgaaattagaagttcctttagcggataatgaaacacagaagcttcccagtggtgaagcaaaaaggatccgaatgaccgccagtgatgcgcttcttgaaggtgatttagtaacagtgacagacgaggaagcattgatgaaaaaagtggttcaagggtttgaatcgaccgaagatcgtttggtttttcaaccaacaatgggacaggctagtgaagcgacggtcatcgtttatcttaaaactcaagattatttgtcattgaatgagcccgtgtatgttcaactgaaaacagatgatgacagccaacgtttggcggtctatccgtcacaatactatcagcctatccaaactactatgaatttgaaagcaggcactatcaaaatcgaagtgtcttcagaaattggggtcgacacactgagtgtcgatcggatggagatcataccaaaagagggagaatagtttctagagctgctttcagtggtttagatatcataacactgaaagcaatggcgtggctcaaatggccatgctgtgatctgtcttgttcaatttagggctgttcttcgatccgaatgaagcaaactaacatcctaaagcagtgtcatggacagacgtgccatgatactgttttttttttgagtaattaggatgagccgctgatagagctctaggccaagataggcagttttccttcttccatgtataataaagacaaatgggacggagcaaatcgttttacaaagtagacgtaaaagtaaatgcaaatgaggtgaatggatgaaaaccaggcaagaaatgattcgatcttcaaacggcaaagatcaactttatgtgaaaatttggcagccggagggacagtccaaaggaatgcttcagctgatccatggcatgattgaacacattgaacggtacgatccgtttgctcaatatctcgtttcaaaaggattcacagtgatcggtcatgatcacttgggacacgggaaaacagtagctgagcaaaacgagtatgggacatttggagaaacaaatggtgcggattatcttgtagcagatgtgggattggttcagcgttttgcgttggagcagtttccagctcaaccttattatcttttaggtcatagtatgggctctttggttttgcgcaattttttgtatcagaaaaatacaaaattggcaggagcaatcattatggggacgacactggaagcgccggccaaaatgaccagtgccgctttattgacgaagtcgttgatgccttttcgacagcaagcatggccctatcgcgtgatggaaaatctggtttttggtcaacataatcggcggtttcagcccaaccgaacggcgaaagattggttgtccagtgatccccaacaagtagatgcttatttagcagatccgcatacgcaatttcatttttcattaagtgcctatcgagatttgtttttattgacaaaaaaagcgagtgccccccgcctgttgcagaaaatcgatcgcgaattgccgttactgctgatttcaggaaaagaagatcctgtgggccattatggcaagagtgtccgtaagctagcaaactatttgaaccagcaagggcagcggcatctgacagtttatttgctggaaggcggtcgtcacgagatcttaaatgaaaccaataaacaagtcgtatttcatgaaatctggcaatggttagaaagcaattgaggaacgttatcaattgctttcatctttttttcagaaaattgagaattttaattatttttaaccttttttcatattcctccttctgctataatgggtgtcacatctaacaacaaaggagagatttttgtatgactgtttataacttttcagctggtcccgccgtcttgccccgccccgtattggaaagagctcaatccgagcttttggattatcgtggcagtgggatgtccgttatggagctgagtcatcggtcttccttgtttgaagagatcattcaagacgcagaagccctcttgcgggaattgatggcgatcccggataactatcgggtgctgtttttgcaaggtggagcaagtctgcaatttagtatggtgccattaaatttagcgaaaaacaaaaaggccctttatatcaacacgggctcttggtcaaaaaaagcgattcaagcggctgaagcagttgctacggttgaggtgatcgcatcaagtgaagataagcattttacttatattccagaaatcacagtagataacatcgaccaaacagcgacttatctgcatattactacgaataatacgattgaaggaacagcttttcagacgattccggatgctggcaaagtcccgatcattgctgacatgtcatcaaatatcttggccaatgagtatcgtgtagaagatttcggtatgatctatgcaggtgcccaaaagaacattggaccagcaggattgacggtggttattattcgagaagatttattaaatgaagaagcggtctttgctccaatgttggactatcgtcttcaagctgacaacggttccctttacaatacgccgcctacttacagcatttatatcgcaaaactggtttttgagtggttgaaagaattaggcggtgtagcagcgattactgcgcaagaccgacaaaaagctgcactgctctatcaagcgatcgaagcatcgaacttgtttagcagtcccgtagacaaaaatagccgctccctaacgaacattccttttatcactggcgataaggagctggatcgacaatttaatgaagctgcagaagcagccggctttaaaaacttaaaaggacaccgttcggtaggcggtatgcgagcaagtttgtacaatgcgttccctatcgaaggcgttcaggcacttgtcgatttcatgaaatcattcgaagcggaggtcaaataaatgtatcagatcaagacattcaatgcgattgcaccagaagggcttcaaaggctaaacaaagaaaaatatgccatcaatgaaagtgatgagccagaaggaatcttgctgcgaagccaaaagctgcatgactatccttttccaaaaagtgtattagggattgcgcgagctggagctggtacgaacaatattccggtcaaagaatgtacagaacaaggcatcgtcgtcttcaataccccaggagctaatgcaaatgcagtcaaagagttggttattgcaagcttgttattaagtgttcgcccgattctccaaggtgctcaatgggtccaaacactgaacggatcagatgtagaggaacaggcagaagccaacaaaaagcaattcgccggtacggaactagaaggcaaaaagcttggtgtggttgggttaggctcgattggtgccatggtcgctaacgatgcctaccgcttagggatggaagttgtgggctatgatccttatgtttcggtggacacagcgtggaccatctcccgcagagtcaaacgggccaatgatttagcagaaattttcacaacctgtgatttcattactcttcacgtgccattgatggaaaacacccgccatttagtgggcaagaatgaattggccaaaatgaagccaacggctaaactgtttaacttttctcgtagtgagatcgttgatacagctgcagctcttgctgcgttagataataatgagattgctggttatacaactgattttgcagatgaacgcttactgggccatgacaacgtgctagttctaccgcatttaggagcatcgacagaagaggctgagatcaattgtgccaaaatggctgcccgcacattgaagaaatttttggagtttgggacgatcaaacgctcagtgaattttccaaccgtagaaatggcgttccattcgccgtatcgtttaacagtgattaaccgcaacgtgccaaatatgctaggacaaatttcctcgatcatcgctgaatctggaatcaacatcgataatatgttgaatcgcggacgtgacgactatgcctacacattggtggatgtcggagcaacagatgctgcattgcttgaagcggtggcagataaattacgagctaaagaagatattattcgcgtgcgagtgatcaagaatcaggaggtaggctattaatggttcaagtttttccttttaaagcaatccgcccacaaactgacttagcagagaaaattgcggagttgccctatgatgtagtcaacacgcaagaagcagcggcatatgctgccggcaacccttacagctattttcatatcgatcgctcagaaatcgatctgccaaatattgctccttatgatccgcaagtgtatgcgaaagcagcagaaaatttggctgcttttcgagaaaaaaaatggctgatccaagacaatgcaccgtcctattatttatatgagctgacaatggcggggcggagtcaaactgggcttgttgtttgcacatcgattgaggattatgtagctggtaaaatcaaaaaacatgagtttactcgaccagaaaaagaagttgaccgcatcaatcacatccaagcttgtgatgcaaacacgagtccaatctttctaagttaccgtcagcctgagtccttaaaaaaaacgatccaggattggcagagtcaccatcaaccgatctatgatttcacgagttaccatgaggtccatcatcgggtttggctgatcgatgattctgcggtgattgctgctttatcacaagaattctcagcgattgatgcgttgtatatcgctgacggccatcatcgtaccgagtcggcagtgaaagtcggcttgcaaaagcgcaaggaaaaaaacaatagtgaggaaagcgagcgcttcttagcgattttgtttccggaaaatgaattggcgatctgggaatacaaccgagtggtcaatgtaccgattccagatcatttcttcgatcatctagcagagaaatttcacattgagaagccaactagcagcaagccttctcaaaagggaaccttctatttgtatttgggccacgaatggttctctttaaccatcaaagaagcagggaatgacgcagtcgaaagtctggatgtttctcttttgcaaaaaaatatcttagcgccattactcggtattgaagatgtccgcacagataagcgcatcgattttgtaggaggaattcgtggtccagaagaattggaacggatggtggattccggagaatggacaatggcctttttgatgtatccaacgcagatgaaagatttattggctgttgccgatgcgaatgagatcatgccgcctaaatctacatggtttgaacccaaattgttaagtggtctgtttttacatgatttagaaaccaaaagctagaaagctaaaaagaaaaaagccgcacgtctgcagagaaaactgcgatcgtgcggcttttttctttttttaaaaaataccagacattgtttcgatgatcaagcgaatgttgaggactgttaatgcgatggcgcaaatccagcccagagaagtgacccacagagggttcttgaacttttcgcccatgatttttttggaactagtaaagtaaaccaatggaatcattgagactggtaatgcaatactcaaaaagacctgtgaatagatcaaaagattatctagtgcctgttcattaccgccaaagtagagggtacatagtaaaacaggtacgacagaaaggccacgagtgatcaatcgtcttgcccatgttggaatcttcatatggatgaagccttccatgacgacttgtcctgtcagtgttccagtgatagttgagttttgtccggaagccagtaatgctacggcaaaaagaacactaagggctggactagccaccgctcccgcgatcactgaattttgtaaggcatcatacagcgctgaaaaagtaccgacttcttcgctgtgaccgaagaacaatgcgctccctaaaatcagcaacagacaattaacgacaaaagcagccgaaagctgaatatttgaatcccatgtggcaaagcgaacagctgtagcgacttcttgcggattcgtccgatcaatctttcttgattgtgaaatcgacgaatgcaaatacaaattatggggcatgacggtcgcgccaacgatccctaatgccatggtcagctgtccagggttcaatacttgtttttggggaatgaagccttgaacaagtgccggaagatcaggttgggcaataatcacttcgtaaacaaaaacaagcagaatcaccaatattaaggtcattacgatggcttcgatttttcgaaagcctaatttcatcaagaaaagcagtaaaaagacatcgaaaatcgtcaaaaagacccctacaactaatggtagaccgaataatagattcaaagcaattgctccaccgattacttcggcgatatctgttgccatgatcgccaactcggtaataatccaaaggaaaaagcccagctttttactggtgtgtttacgggttgcttgtgcgaggtccatatgggtgacaatccctagtttagctgccatgtattggagcaacatcgcaatcagacttgaaatcaagatgacggatagcaggagataaccatattcggcaccacccccgattgaagtgatccagttaccaggatccatatacccaaccgcgactaacgctccgggaccagaaaaagctaaaagattacgccaaaaattcccatccttgggaatagctacggtattgtttatttcttccaagctaggtccatttgctgcctggatcaattttttttcttcattcattctgtcacatcctatctttttaggtgtacctaaaaacaatcttattgtattccttgtttatgaatttttcaagagaaaaacttctgaaagtttgcattaactaaaaaaacagatattagaaaaggacagatttcgtttgccaaggtgattggtgattgttggattgatcaatcctaatctaaaatagggaatgttgctctacatagaattgatgaatgaaggaaatctatttgatcccacttgtttagaaagaccgaaaattttcttaagaaacataaaaaaacaagaagcactcaaaattgatgattttgagtgcttcttgacgctggattgtatgtcgaggatgaatgaacttttatcaggatcttttttatattcttattatgtcaaaagaacaagaagagcagcctttagaatgttaataaccaagtttattaatcaaagaacagccaagaggctgcccactattgtgcgacgtgtatggctatcaataataaaaagtatcattgttttgtgttgttgctgataaaacactgtgtcagcgtgtctacaaattcatcgaaggtggttatggcacttaatttatgaatgttttgttcatctgtacaaatcatggccagatcatcaaaaatttcccgaaacacatgacggttatggtaattgatggaaatcaaaaaaaccaatgtgacacgattatttccccactggatcccctttggattgacggcaatcgcaacccccgtacgattggcattcattgtcagtgaatgtggaatagccactgaaccaaaggcagtagaagaaagttgctccctctcaattacttgtggataaaaggtctcgtccacgattccttcttctttcatttgaccacataattgtttgagcaattctgcggagttttgattttcagttgtatatgagaatcgctttttatcaacaagcgatagaaaggttttcacaaattgttcttttcgttttttttctttgatatcaaagatcttggcggtaatttgttgccgatcttcaagggtaaaaaaaggattaatgatcacgtatggggtagcgatcacttgcttcagtttaacagcagacacaatcagttctgtatctacatactgcaactctttttcactagtaagaatattctggatctcaaggtcatcagagaaatttttctgaagcttttccatcacctgaatattcatgttgtagtaatgaggcactagaatcgtgcagtttattttattcgtacgctgtttttgaatttctaacgcatagcctaaatgaaaagctatgtaggcaatttcgtcttcactaatcgtataaccgatttctttttgaatgacatgagaaacctggacggcacaatcatagatgagcggacattctttttttagtgtttctgtcattgggtttctacaagagtagccgttattgatccgatacagtaaattctttatatggagggcaaatcgaatgaagaactcaggttcattgccatcaataaagtataattcatccacttttgctagaatttttcttactaagtcaaggcagtttttgtccgtgaccttctctaactcatcaggtgaaatttgagtgaaattcacgctagttccattcgctgaaattaggatagctaaatcacgaatttcttctttgggaaaacgaataccgtaccgttccgctactttttccgcgattttttcggaaatttttagtactgtcggatggattgagtgaggcgcttgagcttctgcttcaggagactgaaaatttcctttcatacggtctacggcaattgctagatgaataactatatttgttaacgcataatcattcgtgaaaaaatcatagtctgaaaaaagttcggcaataatttccttgatataatcaaggtcaaaatctataaaactttcttgtagcttagtcatatcaacgaaatgattatccaattcggatagcaatgtctgatggattaattgtcttttcgctttttctgtcccaatcaactgtagtgtatctttggttagtctgacttcgatagccagttcagaacatttttttttaagtttttttgcatcactcaataatgtggactcgctgataaatagttcttctgctagatcataaacagatagagcttcctcggttgaaatcagtcgcaaaaggagataagcagttcgttcagtaggtgtttcagggacacttgtttctgtgttattgaaaaaagtgaccagattacttgctatcactcgatagcctttgtttgaagaaaggatcaaatcagattcattgtcttgaatatctgcgatatacgattttatcgtccgtttggataacccaaatttttccgctaattgagtggaggaaacccaattgtcttgctcatttagatagtgaagaagttttatatactttgctttcattggctgacaccctctctttcaccactgcagtgcaaaagaatatttgtttcaccgctgtagattgactatagtataactgtaattgatagcgctatcaatgaaaattgaattgggggagaaaaatcatgaaaaaattgaatgttttacttgtgtgtggatctggagccagctcaggttttatggctgctaatattcgcaaagctgctgctgaaaaaggattggacataaaaattactgctcgcggtgaaagtgagattgaaaactacattgacgacattgatgcgttaatggttggtccccatctggcgtatattttggatgaagtagaagaatttgttggtgatgcaccagtgaaagtgattttgatgaagcctgaatactatgccacattaaacggaaaacaagctttggatcacttgttggaagaggtacagtagctttcagaatggagggaataaaatgcaatccttaattaactggctggaaaacagctttacgcccaaaatgaataaaatcaatcataacgtttggatcgtgactcttaaagactcaatcatgcaggctttgccattaattttcttaggatcggtcttttgtatgctggcaattttaaatgattattttccaagtttacccaatttctggacgccatacggatggacgatggggatgatctcacttgtcatatcttttctgattcctttcaacttgatggagaaaaaaagactgcgtaagcaaagaatcaatgctggaatgtctggaatcatcttatttttgattattatttctccacaagtcattgctgacggagaacctggttttagtcatagtgcgcttggtgcagggggaatgtttattgcaattgttgcaggactattcgctggtatggtgttgaatttatttggaaagttttcttttttcagtgaggaatcggtgattcccgattttgtccgctcttggtttgatgctatgctgccaatcggtattgttgtccttaccggatggatcttcgttgatcttcttggctttgatgtctacaatgctgttctagccatctttatgccattacaaagtgtgattgagacgccatggggcttttcattgatgatgttgattgtttgtttcctctattcgttgggaatttcaacatgggtattaacgcctgttttaaatccagttttattgactgctattcaagcaaatattgacggaaaggcaatgaatttagtaactgatccaactatttattctgcttatctatggattggcggtatcggctgtacaatgcctcttgtttttatgttgatgcgctccaaatcaaaaaaattaaaagccttgggtacggcttcggttgctccgacgatttttaatatcaatgaaccgattgtttttggctgtattgcttggaatccactattgatggtcccgatgtggttacaagggttgatattgccattaattgtctggttatttacgaaagtcattgcttttgcacctattccaacagtcatgtttcaaatgtggtactgtccatttccgattgccacttggctaactaccggaacaatttcaggcattctgctaatgctgattgtttttgtcgtggcggcagcgatttggtatccattttttaaagcctatgaaaaacaagaatgcgaaagagaagctgctgaagcaactgaaagagtatagaaagataattgtgaaagaaggtcttagaatggtgaaagaacaaatcgttcaacatgccatgcagataattctacatgctggagatgccagaaagcattgtatggatgccttgaaagcgattgaatcatatgattttgcactggctgaagtggaaataaagcaagcaaatgaggagattgtacaggcacaccgcatacagacagatgcaattacggctgaaacatctggtgaagatggagagtattctgtgttgttcgcacatgcacaggatacattgatgactatttacagtgagataaatattgctaaacgcatgctggcaatttttaaagcctatgatcggcgcattgagcaattggagagtagactggaaagagaggaagaaaatgactaaaatacctgaaggttttccaaaagattttttatggggcggtgctattgcagctaatcaagctgaaggtgcgtgggatgtagacggaaaaggctggtgtgtggcagatattaatgagtttcttccagatgttgacttagaaaagaaatctaatatggaaataacgacagcttatatcaaagaagcaatgaacagtacagagcgaatttttccaaaacggtggggaattgatttctatcacacgtataaagatgacttgaaattgcttgctgaattagggctaaaaacatttcggacttctatcaactgggcaagaatttttccaaacggagatgagttggagccgaatgaagcgggtttgcagttttatgacgatttatttgatgaaataataaaaaatggtatggaaccaatgatcacaatgtctcactatgaaatgccacttcatttgacaacttcgtataaaggctggtattcaagagaagttattgatttctttgtccgttatggtcaagttctgctagatcgctatcatgacaaagtaaagaagtggatagtggttaatcaaatcaatttaattgtccatgaatcgttcaatcatcttggaattcctgaggatgcagtagaggatttgctttctgctaaatatcaaggagtacacaatgaaatggttgctagtgcattgattacaaaatatgcgcatgcacattatccagataatgagatcggcatgatgctttgtggcggtccatcttatgccgcatctagcaaggcggaagatgttctagctgcattaaaattaaatcaaatggagtatttctttgcagacgtcttacttcgcggccgctatcctggttatgctttccgttactttgatgataaaggcattcatgtaacttttggagaagatgacgaagaagcactgaagcatacggcagactttatgtctttttcttactactatacacaaatatgcgatcaagactcttacgataaggatttaggaccacacagaaataaggaactaccagcaaatccttgggggtggacaattgatcccattggcttgagaattcttttaaatgagttttatgatcgctatcagtgtccaatttatatcactgaaaatgggattggctattttgataaattggaaaatgggagcattcatgattcctatcgtatagagtattatcgagatcatattcgagccatgaaagaagcaatcaaagatggtgtggatctgcgcggttactatgcttggggacccattgatatagtcagctgttcgtctagtgaaatgagcaaacgctatggatttatttatgtagatagtgatgattatggaaaaggcagtggcgaaagaatcaaaaaagatagctttgcttggtatcaaagagttatccgcagtaatggagaaatcattgactaagattaaagagagttaaagagaatagaagataagtgctggctgctctagctgaatgctttcttttagtggaagcagaccatccacaaactcaaaggagcagtcctctataacccggattttcaggttacaaaagagcttatcgcaggcataaaacaaaaagtactcgaaaatgacttttcgagtactttttgttttgctgagagcaccattaactgacagctgcaatgctctctttagctgtgactagttagaaagaattaatctgcccgcaaagcgatcgcagcatctttttttgctgccatccgtgctgggatatggccgccgatcatggttaggatcgtgctgaccagaattaagatcaatccatggactggattcagttgtgcaacattttccagatcagtcatattgtataagaccgcgttgattgggaaagtagctaaccaagcaatcaagacacctaatgcaccagaagcaatcccaaggatacatgtttcagcatcgaagacacgagtgatatcttttttacgcgcacctaaagcttttaggacgccgatttctttcgtacgttccaaaactgaagtataggtgatgataccgatcataatcatgctcgtcactaatgagatagcggcaaaagcaatcagaacataagtgatggcatccatcaagccgccggtcaattgcgtcatggttccagctaaatcagaataaacgatttgatctttacgatctttgcctttgttgtaagcatcaagatagtccaagattttttctttggaactaaaatcatttggatagatcataatactgtttggcaagtcgctgccacctaagtaatcgattagagaatcgcgcgtgctagcatcgattttttcgttggtcataacattgatatcactgtctttttgggctttgacgattgccgagtttttgttttctttgataacttcttgggctaatgcatcgctataagcgatcccggtagaaagcaaattcatcgtagatttttctttgatacgtaaaatcccgctgatttttaattctttatttgcactgttgtcataaacagctgttaaatcttgatttgggataaagttcccagttggcaattcagtataaaaggcatcgttaagtgccaacttgactgttgttcctacgatatcatcgaaagacactttatcgccgtctttgatatcaaatcctaagttgatcaatgcgttgacgttcgtcacgttgttctcgtcaacgatcagtacaacgtcatttgctgatgcaggatattctccctgcagcaaatcatagttgtctttcaggaagttgccgttttcctcagatagttgttctgggaaggttgaaacgccgattcccgtcgaagcactcattgcggacatcatggcatttgtctgctcgttatcagctgaagcatttgaaaagctgacttgttctactttatcatcgaccttacgcagtaagttcaacgaagtcgaacgagtgtagccaatgttgttgcttaactcaggatcaattttattgagatagtcaagaaagtcctgatcaatattattgatatgggttgcccggtcagcgtcactcagttttgcggtcacttctttagtggacgggaaattctcttctttagtacgagtactgattgcagaagggtcttgttccgtcgttactttagagatcgtgatcgggaaacgggccaatgtttcagactgtgtattatcgatttgcttttggaatccggtcgataaagacaagacgatggcaatgccgatgatcccaatgcttgaagcaaatgccgttaagaaagttctgcctttttttgtccggatattattgaaagaaagacgcaatgcagtgaggaaactcatcttcgtgtgctttaattcaaattgatctttcttttgttcttcaatatgcgggttagaatcttttaagattcgaccatccttgaactcaatgattcgatccgcatactgattcgctagttccgggttatgggtaaccatgattacgagcttttcattggaaagctcttggatcagcttcatgatttggacgctagtctctgaatccaacgcacccgtcggttcatcacaaagcagaatatctgggtcgttggctaatgctcgggcaatcgctacccgctgcatttgcccaccagaaagttgatttggctttttgtgcatatggtccgcaagaccaacccgtgtcagcgcatcttcggctttcgctcgtttgacttcttttgaaacaccgcttagtgtcattcctagctcaacgttatcaataatccccaaatgactgattaaattgtaactttggaacacaaaaccgatcgaattgttccgataggcatcccaatcacggtccttgaaagatttggtcgattttccattaatgaccatgtctccagagtcgtagttgtctaatccaccgatcacatttagcatggtggtttttccagagccgcttggtcccaaaatggctacaaactcttgttttcggaaagcaaccgagacaccgtccaatgctttggtggtacttgatcctactttataatacttcttgatatcttttaattctagcatgctgtcactcttttcttgccattttcatgtttttttcatcctgtttaaaagctatcataacagttaacaaaaatcaacaatcgttattgttttgcagaagttcttatactaaactatagagaagaaaagagggagaaaatgacaaaagcgatagagaagtttgatatatcagtatttgcagaagttttctcactactgggaaaccttttgtttgaagaagttgggtttgaagatttaaaattgacaaagatggaaatacttgaattggttatcatcgcagctaatgaagggatgacgatgtcggaattagcaagacaaatcggcacatcgaaggtccagattagtcgttcgattgctggattggaaaaagctgggtttgtcattcgcaaaaccaatgaaacgaatcggcgcagcgtcaatgtctttatgtgtgaagcgggaagagaattgtttagtcgcaaaaaacaacaaattgaggatcgcttgaatgagaaggtttcggcaatgcgcccttcggattttacagagctttatcaggcgctgactacagtgattggtttgttgcggaagtatgacattttaaaagaacacgcttgctcgaacaattctaaaccaagtaaatgatccccaatttatagcaatgcaaacgattgcttcgtttgtgttatttgatgtttctattatatttctcgcccttttgtaaaaagaagaggataaagcaatcgattgcatattttgcttgtattctcttcttgtgtgtgggaaaatagaggcaacaaataattaaaggagtctgctatgaatactactgctatttatcatcgtccagaaagtgaatttgcttatttatttgaaaaagacaaaatgcacattcggctgcgcacagctcgtcaagatgtgcgtcacgtgcaattattatgcggggatccgtataccttatacaaagaagcttggtaccaacgaaggatcgaaatggataaaatcttgtctacggacttgcatgattattggcaagtgactgtaagtgcagaatttcgccgattgtcttacggcttctcaattgaaagttttgacggtctccatgttttttatggggatcatggggtctatccttttgaagagcaatacttagaaatgaacaacaattatttccggatgccttactttcaagaagcggatcggttcaaagtgccggaatgggtcaaagaaaccgtctggtatcaaatttttccggagcgctttgccaatggcgatccatcgaatgatcctgaaggcacattgccctgggggtccaaaaatcctgatcggcaagatttttttggtggagatttacaaggtgtgatcgaccatctggattatctcgtttcgctagggatcaatgggatatatttctgtccgatttttgaagcctactccaaccacaaatacgataccatcgactatttagcgattgatccggcatttggggataacgagacctttaaacggttggtggaggaatgtcataaacgaggaatcaaggtcatgcttgacgcagttttcaatcacataggagatacttcccaccaatggctcgatgtcattaagaatggtgcagattctccctttgccgattggttccatatcaatgaattccctgtcaattataaagaaggcgaagattttgaagatgcttatgatatcacgtatgatgtgtttgcatttaccccgcatatgccgaagctgaatacagagaatccggatgttcaagactatctcctgaaaattgctcgttactggatcgaagaatttgatatcgatgcttggcgcttggatgtagccaatgaggtgagccataatttctggaagaaatttcgtcaggtctgtgatgaagccaaagacgatttttatattttaggagagatatggcattcttctcaaagatggctccaaggggacgaattccatgcagtcatgaactatgcttttacggatgcaatcattgaatacttcgtcaaaggcgaaatatcaatgacaaagatggtctcggaactaaataatcaattgatgctttatcgggaccagacaaatcaagtccaattcaatattttggattctcacgatacgccgcgtctattgacattggcacgaggcgataaggacctgatgcggcaggtgatggcttttacctacttgcagcaaggggttccctgcctgtattatggcgatgaaatcggcttgaccggggatatggatccggattgccggaaatgtatggtttgggaagaagaaaaacaagaccgcgatttgttgcgcttcacaactgatttgattcatttgcgcaagagtcatcaaaaaatcctttcagagggctctttgaattggaacgtgatttctgaagaagaaggattgatcatttttgagcgggaattaggtgcgcaacgaatcattggaatctttaataccggggaagaccaactcacattgtcttgcccagaggaaattttattagatcagtttatgcagatcgaagatgagacaatgatcattgataataaaggatttgtcattgcaaaaatcaacaatgaaatcagcaataattaaaaaataaaatgaggcaagatctgttaaaacaggtcttgcctcatttaggctgattgggttttatttccccatgcacgttggaaagaatcttccccaaaattctttctactaatattatagcctataacccgtagatgtgacaaataataacagtcgaaaaataacccttttttgaaaaaaagcgaaagaagagggaattttcagattttttctttttctttctgagaatgcttatgtaaggtcttttctttttgcttaaatatgataaactagtaaaaatgtatttttattcgaggagtgatcaaatggatagagggtaccgggtagctgttgttggtgcgactggcgcagttggaacaaaaatgattgagatgttagaaaagactacattgccgatcaaggaattgattctattggcttcaaagcgatcagctgggaaaacctgtgtcttcaaaggagccactttggtcattcaagaattaactacgacctcatttattggagtagatttggctttatttagtgctggcggcagtatctccaagcaatttgccccagaagcggttaaaagcggtgcggtcgtaatcgacaatacgagctacttccgaatggatccgaatgtccctttagtggttcccgaagtaaatgctcatgctttagcaaaacaccaagggattatcgcaaacccaaattgttcaacgattcagatgatggtggcattagaaccgattcggcaacacgcaggtttatcgcggatcattgtttcgacgtatcaagctgtttcaggtgccggtgctaaggcaatggcagaattgacacgggaatctcaagcttacttgtcaggaacaccagctgatcagttggcaccagagatcatgccagcgggcggtgacaagaaacactatcccatcgcattcaatgccttgccgcagatcgatgtttttgcggaagatgattacacctatgaagagtggaaaatgattaatgaaaccaaaaagatcatggaagactcagcgatccaagtagcggctacttgtgttcggatcccagtctttagcgggcactcagaatctatttatatcgaaacaaaacaacctgcggaattgactgcagtcaaagagtggatcaaagcagctcccggagcagttctgcaagacgatccaagtcagcagatttatccacaagcactgacgagtgtcggtaagacagagaccttcgtcggtcggattcgaaaagatttagatgtagcgaatggtctgcacctttgggtggtagcggacaacttgctgaaaggtgctgcctggaactctatccaaatcgcagaatcgctgcatgaacagtctctagttcgagtgtaaatcataagtttttcagaaaagtgtagcgaatgccacgcttttcttttttttgttgtataatgaaagagacggcttaggctagggaaataaatagtgtaaaaaaatcaagaggtgaatagattggaaactatcaaaatcattcctctcggtggtgtacgtgaaaacggaaaaaatatgtacattgctgaagttggagaggatatatttgttctggattgcggtgtccgttatccagaaaacgagttattgggaatcgatacggtcattcctgatttcacgtatctagaagaaaacgcagatcgcgtagcgggggtctttttgactcatggacatgccgacgccattggggcgctgccctatttcttggagaatgttccagttccggtgtttggaacagagctaacgatcgaattggcaaaattgaccgtagcaaaaaacgaagcaacaaagaaattcaaagatttccatatcattgatgaacattcagaaatcgattttggtcatgcaaccatcagctttttccggacaacgcattcgattcctgattctgtcggaatcagcgtcaaaaccagcgctggaaatatcgtctatacaggggatttcaaatttgatcaaacagctatcccaatgtatcaaacggatttcggacgtttggcagagatcggtaaagaaggcgttctggcattgctgagcacctcaacaaatgcagaaaacccagcaccgattgcttctgaattgacgattcaagatgaagtgtttgacaacattcgctattgggaaggtcggatcattgtcgcaagtgtagccagcaatctgcagagggttcaacaagtgctggatgcagcatatcgttccggacgaaaagtagttttgactggtcaggactttggacggatcatccgcactgcgatgaagttgggtaaactaaaattaccagcagaggatttgctgatcacccaaaaagaaatgaaaaagtatgccaatgagcaattgcttattctagagactggccgtatgggtgaaccgatcaaagcattgcagaaaatggcgaacggaacacatcgtacattacggattcaagaaggggatctcgtttatattacgacgacgcctacgacagctatggaaacggtcgttgccaaaacggaagatatcatttaccgagcgggtggaaccgtgaagcaaatttcagataattttcgtgtttccggtcatgcgaatccgaatgatctgcaattgatgctgaatttaatgaagccaacgtatttcctaccaatccaaggagaatatcgtcagttggcagcacatgtggacttggctcatgaagtgggcattccgttgaagaatattttcattaccgcacgcggggatgttttagaatacaaaaaaggcgaaatgcattcagctggtgctgtaccagctgagaatgtcatgatcgatgggatcggtgtcggtgatatcggcaatattgttttacgcgatcgtaaagtcttatctgaagacggtattttcgtcgcagtcgtaacgatcaaccgtcgcgaaaagaaaatcattgcagcaccgcaaatcacttcccgcggctttgtttatgtcaaagcaagtcgtgatttgattcgggaaagtggtgagatcgttgcagagatcgttgaaaaacatttgcatgatgaagagtttgaatggagtaaattgaaacaagacattcgagatcgcttaagccgcttcttgtttgaacagacaaaacgccgaccagtgatcttgcctgtgatcatggaatccagtcaaagaaatcgatcacgcaaataaaacatccagaaaactaggacgccagctacaaacgtcctagtttttgctttgatttttgtggtgtctctttagatacatagcgcagaaatacgagaacattgtccgatcgataatatctaggtcttcattgacagggtgttgtctaaagcaagtgttccaataaccaaacattgaaattgctcctgttttccggtgcggattggtggggtctctcaaggcgtgtcagttatttttgttagtctggctaatttgacttgtccgaatgctggagtgatgtctggataaaaaacaattccacgaagaaactcgtgttaaaagaaaattgattggatcgaaaggatggttttgagtgaaaagttatcaagaagatacgcttgtccagcagagaaaatggtggatcttgattgctgttgcgatgttcacgtttatgtctacattagacggcagcatcgtgaatattgcgttgccgacgatatcggcaaatatgtccgtacccatgaaccaagcggaatgggtcgtgtcggtttatttgatggtggtttgtgcttgtttgttgctatttggtaagattggcgatagttgggggaaaatcaaggtctttcgtctcggcatgttgatttttaccatcggttctttattgtgcgggttcaaccattcgttggcttttttgctctttgcacgagtcgtccaagcgatcggtgcaagtatgacgatggcaacaaatactggaatcattacggaagtatttcctattagtgagcgaggacgggcactggggatgatcggcgctttcgtgtcgctaggatcaattgctggtccaggactaggcgggatcatattgtctcatttttcatggccttatattttttggatcaatgttcctgtcggaattctgactatgattgccggggagaaaattttacccaaagatatcaccatgagccgcaactccatcgataaaagtggatttggtctattctctgtggcgatcttgacctttttcggtggaattttcattggtcaggagcaaggcttcttgacatggttgccattagtattgattttcgttgcaatcattgcttttattgcttttattcaagtagaaaaacgggtggcgatgccgctgattactttcagcattttccgaaataaaatttttacgttaagtttgtttacggcacttctgatcttttctgctaatttttttgttaatgtcgtgattccattttatctgcaaaatgcccgtgggttgactccaagtgtagccggaatgttgatgatggtctttcctttgatgatggttatcggatcgcctatcagcggttatttgacagaccaagtcggtccagaaatcttggtgttgattggcttggccttactatcgattacccaactgatgtacatgtttatgaaccagcatacacctatttggtattatgtggtggctacagcaatcatgggattaggaaattccttgttccaatcgccgaataataccatggtcatgagcagcgtgaccaaagaaaatttgggagtggccggtagcttgaactcttttgctcgtaatctaggcatggtgctagggattgcaatgtccacaacgattctatattctgcgatgagcagtgcctatggtcagcatgtgacgacatatatcaatggacgaccagatatcttcaattatggaatgaaagttactttcttcggtgcgtttcttttatgtgctgtggccctattgatgactatgtggcgtatcaaaaaacaaggtggcttccagaaacattctctgtaagctgcgaacctaaaaaaactgttctagttcttttttctgaagactagaacagtttttttgtgatttcttgactaagagaagaataacgtcatgaatgaaatggatacaccgaattgattgtttggaattttgtattagtctgttataatagaaaatattagtctgtattacttatgaataggaaaggggtaattgttgtgaagattacttttcatggacacgcggttctttcgatcgagttggaagatggacaaaagttgttgtttgacccttttataaatggaaacgctatgactgatctggatgcagaaacagttgatccagactggctgctgatcactcatgggcacagcgaccatgtaggagatatggtggcgattgccaaacgtacagaagcacctattatcagtgtagtggaagtttgtcagtatgcaacaagtaagggagtaacgaagactcacggtatgaatatcggcggctcatatacttttccctttggcaaggtacggttcgttcaagctcagcacagttccggtctggaagaagacggcaagatgatctatatgggaaacccagcgggaatcattttagaagcggaaggcaaaacaatatatcacgcgggggatacagccctctttggtgatatggcactgattggcgaacaatttgcgatcgatgtggctttcttgccgattggtgataacttcactatgggacctaaagatgcagccgcagctgcccacttattgaaagcaaaaaaagttgtaccagttcactacaacacattcccactgatcaaacaagatcccgccgcttttatcgacttgctgcctgagggagtaggcaccgttttggctgtgggagaatcgattgattgttgaccgtctgattgacggattttattaactaggagaaaattatggcgacgaaacatgacttgattttagcgcatatcgaaagtttgccggtaggagaccgtatttcagtacggggaatcgcaaaggatttaggtgtcagtgaaggaaccgcctatcgggcaatcaaagatgcagaaaatatcggtctggtctctaccattcaacgggtaggaaccattaggatcgagcgtaagttaaaaaaacatattgaaaaattgacctttggagaagtcgtacaaatcattgaaggagaggttctaggaggcgcagccggtctagataaggacttgaataagtttgttatcggtgcgatgaaagaatcagcaatggaacgatatatcaccccgggatcgctcgtgatcgtagggaatcgaaatgaagttcaccaattagcattagaagatggtgctgctgtcttgatcactggtgggtttgaaacatcagaagaaaactgtcgtttggccgataagctggaactgccaatattgcagacgacttatgatacgtttaccgttgcaacgatgatcaaccgggcattgagtgaccagctgatcaaaaaagatattatgctcgttagcgatatctatatgccgctggaaaaaacaaagtatctgcatacgtttgacactgtcaaagactataaacgtctttcagaagaaaccaatcattctcgctatccggtagttaacaagaacatgcgcgtggttgggatcattacggcaaaagatgttttggaaaaacccgatacgcaaatcattgaacgaatcatgactcgtgaaccgcgagtcgtgaaaaaagagatgagtgttgcttctgccagtcatcaaatgatttgggatggcttggaagtgatgccagtagtagcagatgacttatctttgatcggaatcgtgactcggcaagacattatgaaggcgatgcaactagtccaaagacagacccagatttccgatacgatctctgatcagatttctggtcagatccaaatcattgaacaagattttgaaggcaataaattggcacagccaaactttcgtttcgctgtgactccacaaatggtcaatgaagtaggaacgatttcttttggtgtgctcagtgaagtgatcgccaatgctgccaaacgaacgatgcaagtcaatcagcggcgaaacagctggatcgaacaagtgaatctacactatttccgcttgatccaattagaaagtgagatcattattcagcccaaaattttggagctggggcgccgatctgctaagatcgatattgaagtctatatcgaaaattccatggtagctaaagcaattgtcgtctgccaagtaatggagcgcccttaattcgaacagcagtcatcagataaatgcttagaaaatggagatatgcaatgaacgtacaagaggaaatattgacagcaattaaggaatatcagacaattattattcaccgccatcagcgacctgatccggatgcactagggtcacaagttggattggcagaaattttacgagctagttttcctgaaaaagcgatctatcaagtgggagggcctgttgaagggctagactacttagcagaaatgcaggagatttcggatgaagtctacaaaaatgccttagtgatcgtgaccgataccgccaattcaccaagagtcagtgatcagcgctatgccaatggtgcaaaattgatcaaaatcgatcaccatcctaatgacgaaccttatggagatttggtctgggtggatactactgctagcagctgcagtgaaatgattacggcattctggaaaatgttcgctgaagaacttactatgtcgcaagaagctgcgcgcctgctttatgccggaatcgtaggggatacgggtcgtttcctgtacccagcaacgacctccgcgacattgcgttacgcagctgatttgttggattatggttttgatgcaccaaaaatcaatcgtgagattgatcaggtttcgagagcagtggctcgtctttccggctatgtctttgaaaatttagaagttgattcactaggagctggcaaagtgattctgacaaatgagattcaacagcgttttggcgttgttgattcagaaacatctgctatcgtgtccttaccagggaagattgaagatgtcttagcatgggcaatttttgttgagcagccagaaggctattatcgggtccggatgcgttcgaaaggacctgtgatcaatgagatcgccaaacgtcatcatggtggcggacatccgcttgccagcggagcgaatgcagcggatctggaagaagtggcagccatctatcaagaaatccagaccgcagtttcagcttttcgagaacaagcatagactttattcgtcgtgatcagtgttcttttgcagaagaaaaaaccaacagcgaggaatcttaggacttgctaggggaatgatcggtgagtttttgattgtagtaaataactgtagtaaaaaattacgcaaataaaaaaagcgtatgactcgcgggtcatacgcttttttgcaagttgcaacaggcgagatcagccccgcaagtcgtcaagaaactcggttttactagccgtcttttcatctttcatcttgatgactttagccggggaaccagcaactacagcccctgccggtacatcttctgtgactacagatccagcagcaaccacagcaccttcaccgacacgaacaccttcaaggactacggcattggcgccgatcaacacatgatcttcgataatcactgggctagctgaaggtggctctaagacaccagctaaaacagccccagctccgatatgggcttttttaccgacagtagcccgggcgcctaaaatcgcccccatatcgatcattgtttcttcgccgacaacggcaccaatattgatgaccgctcccatcatgatgaccgcattcttctcaatgattgcttgatcacgaatgaaagcccctggttcgatccgagcatcgactgttgttaagtccaacagagggatcgcagaattccgacggtcattttctaaatagaaatcagtgattttatcttgattggccgttagaaaatcagctacttcttgactgtctccaacaataaagtaaaaggagccagccccaaaaattttcagtgtctcggaagaacaggtagatagatcaccattcaaatagactttgactggggtctgcttattggcttctttgatgtatttggctaattgataaggatcagaaaattgtaattcagtcatacgttaccacctttacttgtcaagtagattttccatgtcatatagtccagcaggttgttgtgcaagatattcggcagccttcaacgcaccattggcaaaaatatcccgtgataatgcggtatgtttcagctcaatgatctcgtctgctcctgcatagatcaccgtgtgttcgcccgggatcgtgccaccgcgaacagcgtgaatacctaattgttttcgatcattggtcagatcgttgccagaacggccataaagatattcttttggttcttgacaactttcattgatgctgtctgccagtaacaatgcagttccgcttggcgcatcgattttttgattgtgatgtttttcaatgatttcaatatcgaaatctgcttccaaaggtggggtgatcgcttttagggctttgatcaatacattgatccccacggacatattcgcagaataaaaaacaggaatcttttgagcagcggcgaccattttttcttgggttgcttgacttaaaccagtcgtagccacaacgatgggcagttggttggcaacacagaagtcaaggaggcctgctacattgctatgatgtgaaaaatcgatcaccaaatcaacaggttctttgactgcttctggtgcagaatagattggaaagtcgccagttgcttccgtgtgacggtctaatccagcactgatcacaaattcagcatgtccagcaatcatgtgctgcaaaacttttcccattcgaccattggcaccgctcaataaaatatgtctcacttgattgcctccttataaaagcccataagcggacatttctttttttagacggttgattgtttctttctcaggcggtcctaatggcaaccgatagtgcaagtcagactttcctaataaggaaactgccgctttgatgggcactggattgacttcactaaaaatcgcatcgatcaaaggtttttgtcgtaactgctcctgaatcgctgcttgaatatttccagaaagaaaatctgccaccaaagtcgctgtttgtttaggggcaatattaccgatcgtcgaaatcacaccagaaccgcctaatgctaagattggtgtgacttgatcatcattgccggaatagagagaaaattcatcatccactagttgcgcgatagacgcaatttgtgagatatctccactggcctctttgattcctttgacattcggaatctcttttaattcagcaaccatgtcgtaagtcaagttcattcctgttcttgatgcgaccgaatataagatgacaggcagttcaacgctttgacaaattgccttgtaatgagtaaccaaactcttttttgttgctttgttgtaataaggggttacaaccaataatgcgtcggcaccgacacgctctgcttcttgggaaagatggatcccatgttgcgtattgtttgaaccagtgccaccgatcacaggaatgcggcccgcagcctgcttgacaaccgcctcgataacagcaatgtgttcttcatcgttcaatgttgaggcttcaccggtcgttccacaagcgatcaatgcatcgctaccttgctggatatgccactcaaccagtgacttcaacttgtcgaaatccaccgaaccatcatgaaacatcggggtgatcaatgcaacgccagaacctttaaaaatcgtcaaactactccacatcctttcaacctttttattctttctctaattgtactaaaaatcaaaaaattttgattatttatactatagattattcgaattatatactataatattatccaatatcaatggaaatgtggatatccatacattttcagccgatattgctgatcaaatgaaagaaaggtgcccacgaatgcaattatctcaagcagtaatgaaattaaccgaagacgtggttcgttttcgacgggaactacataagattcccgagttaggattagaagaattcaaaacgaaggaatatttgcttaaacagttgcagtctttcgggatcaaagaaatttatccggttctggataccggattgatcgctgtttttcgcagtgaaaaaccagggaagacgttagcattccgcacggatatcgatgcattgcctatcaaggaagaaacgaatgctccttttgcctcgcaacatctcggcaaaatgcatgcttgtggacatgatggacatatggcgacgcttttaggttttgcaaagtacttatccgattacccggaagctgttcgcgggaccattgtgttgatttttcagccagcagaagaaggccctggtggtgcgcagctaatgattgatgaaggaatcttaaccgattttgcgattgatcagattatcggtctgcatgtttttccagactatcctgaaggtgtgattgcttgccgcaagggaccaatgatggctcgaaatggcgagatcacgattcgagtcctgggagaaagtgctcacggggcccaacctcatcaaggcagcgatgcgatcttagcggcagctgcggtcattcaaggtctccatgcaatcgtttctcgcaacattagtccattgtcttcggccgtcattacattcggcaagattcgcggaggagatgcagaaaatattattcccggagaagtcgtgttgaacggaacgatgcgggcttttgaagatggggtctatgaaacattgacgcaacgagtaaaattggcggctgaagagattgctaaagggtatggctgttcagcagaagtttctttcgaacacttgtatcgggtggtagacaatgatccagacatggtagatgctgttcgggatgttgctggcgacagttatatcgagacaccgccgtacatgttagcggaagatttctccatgtaccaaaaagagatccctggtgtctttttctttgtcgggactcgggatgaagaaaaagggtatacctatccgctgcacagcagcaagatgaattttgatgagaaagtcttattaggaggcattgagtgctacctgcgattgattgaaagattgaatcagagtcaggtactaagagaggagcgcagtaatgatcaaagagattaaagacaatcacctgttttgggatggatgcgatacagtggcattagcaaaagaatttggcacacccttgtacgttttttcggtgaccgagattcgcactcaatgtcgtgctattcgcgaggaatttctgtctcgctatgaaaacacccgagctgcctatgcttcgaaagccttcaatacactagccatgctgcggttgattgatgaggaaggcctgtctttggatgttgttagtggcggtgaactatacacagccatccaagcaggatttccagcggaacaaatcgaattcaatggcaacaataaatctattgatgaattggcattagcgatcgattatggtgtaggtcggatcattgtcgatggcagtcaggagatcggtttgattcgagcgctatgtcaagagaaacagcggaaagcaaaagtgatgttccgaatcacaccagaagtgaatgtccagacccatgcgtttatttcaactggacagaaagattcgaaatttgggatcccattggatgaagagattttatttcctttgattgaagaagtgattgacgcaccggaaatcgatttttatgggttgcatttccacatcggaagtcaattgtctgacaatcattcccatattgctgcgacagaggctgcgctagcattagttctagaaatccatcatcgatttgactatactgttaaagagttgaatgttggcggcggatttggtgtccgctatacggaaaaggatattcgtcaaccctattcttactttttggacccggtgatggcgacgattgaaacgttttgccaagcgcatcagctccaacgtccgactgtggtgatcgagcctgggcgtagtattgtagcggaagcaggtatcagtctgcatactattggtacgatcaagacattgccacagattcgaacctatgccagtattgatggcggcatgacagataacattcgtcccggtctttatcaagctgaatatacggggattctagccaatcgggcagcagaagctgccacagagacagttacgatttctggcaaggcttgtgaaagcacggatatcttagtcaaagatctgcaattacccaaagtagagacgggagatctttttgcgacttttgcgacgggagcatatggttattcaatggctagcaattacaataaacttgcgattccagcggtagtttttgttgaaaaggggcacgcggaattggtggttgaacgtcagactttccagcagttgattcaaaatgaacgtatcccttcgtttttgatgaaagaataaaaaaaagcaggtgaaatcatggaaatcgtttataccaagatgcaaggtgccggaaatgattttattgtgatcgacaatcgtcgctataatttttcttcgaaacagttggctaagttagcggctcaagtttgtcagcggaaattttcaatcggcgcagatgcgttgatggctgtcgatcatcccgaaggaacgggagatttccgcatgcgtttttataatgcggatggtacggaagcggaaatgtgtggcaatggtgcacgctgtatcgctcgctatgcttatgaaaataaggttgcttcagaagcaatggtgatcgagaccgttgcaggacctgttcctgcttggcgattggatcggcaacagtacaaagtgacgttaaatccccccaccgttgcgaagtttgaccaacctttcgctgacagagaggttcctgtcgttgattatatcgagttaggtgatccaggaatccctcatgcggtggtgaagtatcccggtctgcaagaaacatccctcgatgcattgacagatttagcacaacggattcgctattggtcagcatttcctaaaggcgccaatgtgaatttctacgatgccgattcagctggggagctcgttgtccgcacctatgaacggggagtcgagggctttacgtatgcttgtgggaccggctctggggcaactgcttatgcggtggcgcgacgccgggaacaaacgcaagccaatcttgtgctgcatgttttaggcggagagctgcgagtcgaagttgcatcagaggagctccaactgattggggatgcgatttttgtttctgaagggcgtattttagacgaaaatctatttttagactgagggtggtcttgcgacggaattatcctgttcatagaatcatttaggcgacagttcttatggaagccttattcttagaagccatctttagctagaactgagaagatcatcaaatgcaatcgatagaacttagtttgttctatcgattgcatttttttgtgcaggatattgcaggatagtcagaaattttgtatgctacagttatatttattttttcacgatcgtgctcgatcgttgaataaacacagaatacatcactatgaggagtaagaatatgtctcaaattccaaattgtccagtttgtcaatccgcctatgcatatgaggatcgcggcttgtttgtctgccctgaatgtggcaatgaatggcaggaaacagaagaaactgctgctgtcgtcaaagatgccaacggaaatgttcttcaggatggcgatgccgtgacggtcatcaaagatttgaaagtcaaaggtgcttctggtgccatcaaacaaggaaccaaagtcaaaaacattcgtctggtagaaggggatcacaatatcgactgtaaagtcgatggtttcggtgccatgaaattgaagtcagaatttgtaaaaaaactttaaaaacagaatcttccatacctcttcataatattttcatccatttaatggtaaaataaggtcaaagacgaaagggagggatttcatcgtgtatggaatcggtggatacggttttggttggttttatgatccaacattcattttggtcattatcgggatggtgatctcgatggcggcttcagcatacgttaaaagcacgtttagcaaatacgataaaataagcagtagaaacaatatcaccgggaccaaggcggctcagtatattttggaaagccaaggcatcaacaatgtcggcgtccaagctatcgcaggagatttgactgataattataattccggcaacaagatgctaagtctatctcaagcaactgcacaatcaacttctgtggcagcaatcggagtggcagcccatgaatgcgggcatgctgtgcaagatgctaaagggtatctcccattgcgtatccggcatgcgatcgtcccagtagctaatattggttccgcggtgtcgatcccgttgattttgatcggggttcttttgagagggtccttcctaatcaatctggggatattagcattctcgttagcatttattttccaattggtgacgttgccagtcgaatttgatgcttcaagacgagcgttacggattttagccgatggcggtctcttaacggaagaagaagtaccgcaggcccgtaaagtattgtttgctgcagccttgacttatgtggcagctgcagttgcgacattgctgcaattactacgtttgattattttattcggcaataacaatcgccgcgactaatgaaaagaaggagacttgagaatgctcaagtttcctttttttgaaattgtcgttataataaaaagaaaaaggtggggaataaatgaaaaaagaaacatggctgcggtcgctttttgcgttgatcggggtagctatcatcggttttggcgcctccttgcttcgcgtaggtggcgtcgggctggatccgtatacagctgccaatattggaacaggtgaacggttaggtctttcattaggtgtttatcaattaatgatcaatctcgttttgttgatcttgattttcttttttggtcgtcggcatattgggatcggcacagtgatcaatatggtcttgacgggcttttttattgatttttatacgaaaatctttgaacttttcgcagtttctccggaaggttggctgcaaaaagggctctttttagtgatcggtattctgttctttacctttggtgcttccttctatatgtcagcaaaagtgggaagtgcgccttatgatgcgatcgcaccgacaatcgttgatcgaacgaaagcgaattatcgggtcgtcagagtgatccaagatgtggcttttgcgacactcggctggatcacaggtggaccgatcgggattgggacatttatcagtgcctttctagttggtccgctgatcaagttctgggatgattacgcctcagtgccgttcatcgaaaagaccatcaagaaatctttatttaaatgagcgcggacctatcgaaacaacaatgataagtagcagatgatagataccagcagtacaaaaaaacactgtagatatgctattgatcgatttcaacgatacctacagcaataacgaaagactgtgacaaaatcagcagtgaatgggcaatggatagcgtaaatcgttttcgaacgaacgatcctttgctgacctattttaggtttgatttccttctgttgatttttgtcacatttttttcaaaattgcctgacgctacttgcacaatcgctgagcactcgctatgataagagagcttaggagggatcatcttgaaattaccagcagcattcattaccaaatatcagcagttactaggagccgaagcggcggccttttttactgctttagaaacagggcatccagtaaaaggatttcgcttgaatccgttgaagccacaagccgtctcgatgctggaaatgtttggaccggataaaagtccagcaccatacgcaatgaacgcctatattggagaagtcaaagggaaatcactgcttcatcaagcggggtatgtctacagtcaggaaccaagcgcgatgatcgttgcgacgatcgcagatgcacaaccaggagaaaaagtgctcgatctttgtgcagcgcctggagggaaaaccacgcaattagcaagtcagatgcaaggcaaaggtttattggtttccaatgagatttttactaaacgcgcaaaaatcttatcggaaaacgttgaacgatgggggatcagtaatgtggtggtgacgaaccatgcgccgcaagaactgacgccgcattttccacaattttttgacaaaatcgtggtggatgctccttgctcaggagaaggaatgttccgcaaagatcctgtggccatcgcggaatggcaagctgattcgccactgcagtgcgctcagcgccagaaggagattttggctgaagcggttgcgatgttaaagcctggcggacagttgatctactctacttgcacgtttgcacctgaagaaaatgaagccatcattgaatggctggtctcagcatatcctttttccattgaaccgattgaattggaaaatgtgtctcatggacgccacgattgggcaccgatgaacgacattgaaaagacgattcggttatggcctcacaaaaatcaaggggaaggtcattttgccgcaaagctgacctatcttggatcggagaacatagccaaaccaaagaaaaccaaaaaaaccaaaaaagcttctgggattgattctgtcacgcgatcactttggcaatctttccaagaaaactatccatttttaaaagagactgctgccgatatccagctttttggggatcatctgtggttagtacctagtgaattaccatcactaaaaggggttcgcgtattacgtccagggcttcacgtagggactgtgaaaaagaatcgtatcgaaccgagttttgcattggcaatggcgatcaaagaaaatgatgaagcacctttcttgtcaattgagttagctcagtggcagaagtacgtggctggtgaaacgattacggtacctggaaatgaaggctgggtcgtcttgaaggtggctgaggtcccgattggcttcggcaaacaagtgcaaggtgtggtgaaaaacttcttcccgaaaggattgcggttcactctggaataaacgaaatagtatttttatttgatcggtcgtgctatcatagaagtagcaaataaagggagctgatcgatatgaaaacatcaacaaaagtaacgattggattaagtattgcggcaattgctggcatctcaacagcagtcgttgtctcagacaaagtcgtgaacaaagtacgcttcgcttgcaaccgtcacaaagtgaaaaagtttgttgacgacaaatttaatggcaacgaaaaattattaggtgtcgtcgatgatttgacggataaagatttagatgcattgctcggcgtcatgaagaaagtcaaagacagccgtcataaagtctcggtttatggagataacgtcaaagatgcaacagagaatgtcaaagacaagttaactagctttattgatgcagtcttttaagctaatatctccttggagaaaatgctgttagaagcggccagaagatcgttgaaagaacctgccagtggttgtcctgccatagcagttgtttgactaggcttcatttggcgcttcttttttgttcagagaaaaggaaaataggaattgggagccatagcaactggaacaggtacggctactgaatgactgcgttaaaaaattgccagagcttttctatagagtcagtgtcagctttccatgtttatcccaattgagaattgaaaggaatcattttgaagaaagaaagtaccctcacacaaagtgaaaaagaatattttatgcgtgaagcactgaaagaagcgcaaaaagcggaagcaatcgccgaagtccccatcggggcagttgtcgtcttagaggggcaaattattggccgaggacacaacttgcgggaaaaacagcaagaggcaacagctcatgccgaaatgtttgccatccaacaagcctgccaagccatcgaaagctggcgcttagaacaagcgcagctatttgttacattggagccttgtcctatgtgtagtggtgcaatgatgctggctcgtgtcgaagaagtttactttggcgcctacgatccaaaaggcggtgctgccggttctttgctgaatctgttggaagatgagcgtttcaaccattggtcctacgtagaaggcgggatcttggaagaagcgtgcgggcaagtgctaaaagatttttttcgggcattgcgccaaaagaaaaaacaaaaaaagtctggtaatctatagaaaaatacgttatactaaattttgccgaaaggctaggacaatggaggtcttgtgaagcgtgtcagatccggaaggaagcagcactaagcaggagtctccatgtgtctgattgaatccctattagatagccttttggaagacctattttgaatagataacaggtcaaggggcaaaaaaggggcagaattgaaaatttaataatttaaaccataacctagtgattagaatcctaggttatttaatttttctacaatatcggttttttgtttttcagttacatgagtataaattttcaatgtagttttttcatcgtcatggcctactctttgcattatagcttttatgggtatgttcaattcagataataaagaaatgtggctatgcctaaaaatgtgagaatgcagctttttgtttatttttttatccccaagcttctcattattataatctagagcggcattgaatgtattcacttggattggtaatcccgttttgcctataaaaatgtagctgtcgttatcataatgatcatacttcaatttattttctaaaataacttcatccaaaatttcaataactcgattagatattcctattgttctataagatgcatcagtttttggcaattcttttgttgcattcttatagccttttgagtaatctaatgtgccgtgaatatctaggagcttctcttcttttctataattctttacttgtaaacttattgcttcaccaattctaacacctgttaagtacataaactctactagatttcccattcttttagattgatgagacgaatagtatgctgttaataatcgattaacttcttctttttcaaggtacaaatcttggactctagagaatgtttcaagcgttttaggtggtttaggtataattaccttcctcaatggattatcttttacatactgcatatttacagcgtaatcgaaagccatatttaagactgatttgtattttgatttttgaacgtgtgaaaaagtcagtgagttaataaacttttgaaaaaattgactatctgtatttcttatttttgctttcaaattaagattatcattcttcttaaaagacttcataatgtttgtataattacgaatagtatttgatcgtacagtttgagaatgaaaatcccaccattcatccagaagctcttgcaatgtgtggtctgattttttttccgcagttagtatcctgtcgattttttcgtttaattctttttgtgcttgctttttggctacatttgatttgctagttaatgtaatacttactttttttagttcttcagtataagggtctttgtatctttcgatatatttatatttacctttagctaattcctctatccacatattcatcatctcctatttatgataaaataggcacaacaaaataagctatgcctttttagctaatgcactcttactttcgacggtggggtgcatttttttatagctgtacaatataaaccacaacttttccatatattcttaattcttttgcatcctcgtaacttaccactatatctgtgaaggcgatattactggaatcaggtctaaaaataattctctgattttctttatcgttaatgaatctctttactgaaaactcattatcattactaaaaacaacaatatcctcgttcttcaactctgaaaagtcatctatgcgttttactgcaataagtgatccgttaggaatcacattgttcattgaatctccatttgtttttgtaaaaaatatatctgtcattccagaatatttccccatagcgtaatcaggaatagctatttgctcaatgtgatcttcctcaaaggcttcaatagatgttggaaggcctgctgcaatgctagtatcgaaaaaattatagtcatgtgtatcgtgataaaaagctgttatattgtttcctctgtcagtattcatacgacttaaattcatgcccgctttattagctttattgctaagctcaagaaatttttcgaattgttcctcttgagaactacttttcgaattaagtaactcgtcaaaaacttctttcttcatgtcgtgtaaatcgtaatttcgcgaatacctcggatcaatatctgctttatccacattgaaagctgcagctattgcttcggcattttctttgtttattgttgatttttctataaaatatccagaaagtgttgaggttggaattccagttttctcagatacctgggcgcgagtatagccatgagtgattcttttcaagttttctgcgatgattcgtcggatttctttatcttcttgagaaagtggttttcttgccatgttattttgacctcctttttttgttaataatatcgtataaaatcggataaaacaagtataaacgcgtacaataactatgttttttaataaaaaaacaagacaaatacgttgacaactcgtataaactcgtattatagttgtatcacaagagaggagttgaaaaaaagatggttttcaaaattactttagaagcagcgagagttatggccgatttgtcaattagagaagctgcaaaaagctttggtgtgcaccccgaaacgttatctcgttgggagaaagacccatcgaaaatgaaacaaagggatgtaaagaaaattgctgaaatttatggtatccctgtagaaaatattttttttggttctaaaaacgagtttatactactaaataaagagaacggacttttttctttaaataacaaatgaataaaggaagtgtcatggagatggaaatttccaaggttaatgtgattaacgttgttcaaaaatttgccaacaaagaacaagcaatggaatatttcggatttgctaagaaaagtacagctacttttcagagatatttagcagaattcaaacaacataaagatttcgggtccggatatattaacccaactggtggatatgtattgattgacattgataaatttgaacagttcttgagatggaaagacgcgaataaatttcgaggtgatagttgatgaagtattcactagaccaagagttactcattaacaatctcataaaagaaaagattcaagatttgcaccgactcttgcatgataagaaaaatgtggtaagtgatcgacagcaagaaaatgctagaaaggaacttaagcagtatcaagaactactttatcaaaatagattgaatcggcaaatagatttgaggtgagagaaatggaagaaatcaaaggaatagaaaaaaatgagagtgaagatttgttagaaatgtatgaatctgccttttcgggatccgaacaacagctatctttagcagctgtagggacctttaatcgattgattgatcaattcgaaaaagaggaaatccgcacaattgcagaaatcctcaaagctttagctacagccccaactgttttgcagcgttaattttatctttaaccgaaggttgttttttcttccgctcgtcatttacttgcctaatttttgaatcggcaagcgaataagctgcttcgtataattcaaatttctcttggattgtcaaatttggattagaggaagaaacaacagctaaagcaaactcttttgcatcaacaaacaaataatcatctccttttgattatttcagccgaccactgactgataaggagattatacaacagaaaggaaaatttaaaatgaacaacttagtagtcatgaaagatcagcaagcagtaacaacaagtttacaagtagcggaaacttttggaaaaagacacgaccacattcttcgagatattgaaggggtgaaaaaagatgtccccaaaattggggagatctttgtagaaggcaacgaaccggattcttatggtcgagatcgccgtgttgtttatatgaatcgtgacggattcactctgctagcgatgggattcactggtaaaaaggcgcttcagttcaaactgcaatatattgaagcattcaacaaaatggaagatcacatcaagaagcaacagcagttaccaacatcaccacgcgaattggcaaaactggctttagctgctaacgaagaaacaaatcagcgtattgatgacatcaacgggcgtttagtagatatcgaagaaaacaaactgatcactactgaagataaagggactattgatcgagcggttcaaaagaaagtctacgaaatatgcaggaatcaacatcttggccaaggtgctaaaagcatgctgtttcaagacttaggttcaagtatcaaacaattgtttggagttccgaatcgtggtcgtatcaaggacaaggacttctcaagagtattggggttcattgatcattggcagccgtcatcagtgacaaaagagcgtattaatcaaattcaaacagaattggaaatgtgaggaggtaattgctatggaatttgagaacgtcaaagatgcgctaaaaagcgcgatggagtatgccgaatcatcgagtattcaaatagacggaaagccagcaacatatgaggactttcaagaacttatgaaagagcatatctatgctattgcagacttgttgggtattgatgaagtgacggacaacaactggagcgttggataaaggagactgcaaatgaaaagtttacgtagatcagcattcattatcacggtatttttcttaggcgtttggttcggtaatcatcaccagttgccaagttgggcaatcatcgcattaccagtgtcaagtatgtggtggtttttcaaatatgacgagattgcttatagaagacggttaaggaggggagtacaaaatgctgatagaagaaaaacttcatcagttccaatgcaagagctgcaatagaaagaaaatcatcaacgctacagaattgaaaaaatgtgagccgtggaaaggtccctactgcacgaaatgcggcagacgtctcaaggaagtcaagaaattatatacaaaaaaatagcgactccgccggcaagcaaagagtcgcatacaaaacatatctggctacattgtagcacgagaggagaaattttcaaatgattactattactggacttaacgatgacatctatacagcaatgcttgggaatgctcaagagcgagtaattgataacatcatgactgctgccagtcaaggacgtacaagtattacgatcgcaagcaagggactaacacctgccttcttagctcaacttcagaacgaaggtgtggacaatctggtagaacaagacggacgttacaaattattttgggaattttaagaggtgattatatgaatgatttcgattcattaggcgctcgtcaacagcctgaaattgaaacaaatcaggtcgctgttgattggaaaggcgaaccactttacaaaggcgacatcgtctactcaactgatttagggctagttcacgaggaccaaatcatggactatgtaaacgaaaattacagaaaaattgaaatcggaggaatttagaaaatggctaacgaaatggcagttctacaaaaagatattaccgatgttgttttgggtaaagtaaccgaattagaagcacaaggggttcagctgccgagcaattacaatgctgcgaacgctttgaaacaggcattcttcaaaattaacgaagttcagttaagccgcaacgagggtggcggtttgtatatggaaaaatacggaaatacagcagtaggcaaagccagtattgccaattcattgcttgacatgattcaacagggattgaatcccggaaaaaatcaatgctatttcattgcttatggtcaaaagcttcaaatgtcacgctcttactttggaacacaagcggcattgaaaagacttgatgaaatcgaaaacgtaaaagcggaagtgattagaaaaggcgatgtttttagaattggttcagttgataacgaaacagtagtgacagagtttgaaccaagctttgaaaacatggataacgaaatcatcggggcttttgcaacgattacaaagtcagacggcacgaaggtttacacgattatgacgaaaaaacaaatcgataaatcgtggtcgaaggcgaaagttaaatcagtgcaaatcgactttccggaagaaatggcgaaaagaactgtaatcaatcgagcggcgaagcagttcatcaatacaagtgacgatgcagaactattttccgatgctttcaatcgaacaacagaaggcgactatgatcacgaaatcaaacaagccgaacctgtgaaggtacaagcgatcgaaaataaattacagcaaaagttaggcattaagcaatccgaaccaatcgaagaaaaaccgatcgaagaaccgactccgatcgaggatttgataaaaccgaaagaacaagcaatcgaaccagaaccgcttgaccttgatgaaaacgaacaagtggcaaacgatgtcgaaccaatccaagatgacctggggctgattccgaatttcggcagagaggaaggtgccaacgatgaaggaatcctcccagaagaagattacccgttctaagatcaagctcaatgatgataattactacggcaatgaagcggactggcaatacatgtcggtatctcaatacaaaaactttctcaaatgtcctgcggctgctttagccaaactaaaaggtgactggcaaccatcatctgatccaatcgctttattagttggaaactacgttcattcttattttgaggatctagctgttcatgaaaaatttaaggaagaaaataaaaacaggatgttttcttctcggaaaccttatggacttttgaaagatttcaagatcgctgaacagatgattgatcgattgattgtcgaagatgcgttcttgaatttatatcaaggcgaaaaagaagtgatcgtaaccggggaactatttggtgtcgagtggaaggggaaaattgattgcttaaatctcgaagatgactatttcgtagatatcaaaacaagtaaagatattcatgaaagaaaatggaatgaggtttacggtcaacgatgcaccttcattgagaattttgggtacgtcttgcagatggctgtttattgcgaattactcaaacaacaatacggaaaagatttcgttcctataatcgctgcagtttctaagcagacaccaagcgaagcgaagttgatcacgctggacgaggacaaaatgtcattcgagttaatcaacttaagagacaacatcgatcgtattcaacggataaaaatgggtgaagaaaaaccagatgcttgtggaacttgtgagtattgccgggcaaatcaacgaataaccggatttacaagtatgaacgacttgtaaggtggtgagtaaatgaccggaggatggataaagctttaccgccaattactcgaaaaaccaatatggcaagaatctacaccagagcaaaaagtcatattgatcacacttctttctatggcgaatcatgaggaaaaagaatgggaatggcaaggtgaaccttacaaagctaatcctggtcaattcgtcacatcactagaaagtatcaaaaggaaatgcggtaaagggatctctatgcagaatgtaaggactgctctaaagagattcgaaaaatacgaatttctaacaaacaaaccaacaaacaaaaataggcttataaccattgtcaattgggaggtttaccagtccaaggacgttgacctaacaaaggaagtcacaagcaactcacaagcaactaacaagcagctaacaactaacaagaactataagaatgataagaatgaaaagaatataaaagatattacgtcagggaaacgcaaaaagcgcgtttacccagacgacgaccctaataaaattcttgcaaaaactcttttcaaactaatcaaaaagaatcaagacatcaaagaaccgaacttggatgattgggcgaatacaattcgcctaacaatcgaatctgataaacgatcgggcaaggaagttcaagaaatgattgtctgggcaacgcaacatgaattttggagtggcgtgattttatcaccgtccagtttgagaaaacattacgacaagatgaaggctcagaaagaaaatcctattaagaaaagtatcggtcaacgtttgaaatcagaagaagactacgattacaacaaactgccgttttaatgaggtgaaatatggaaacgctaagtcaaggcattcagaaaatgatagcgcagaggctagaagttcgtggcaagtgtccaaactgtgaggggaatatgtacggatggaaagaaaagaaccctgatggttcagagcgttgttctccagtttgtatggcttgtggctactatgatatgcggcgcaaagaagacagagaaactgatcgaatttatcaagaaagcttgaagaaaaaaacaattgacttcttcaagttcggttcagttttgactgataaaagtttgttcgattgcacatttgataattataaacaaatggatgaggaaacaacttcagcagccaagatggcacaacggtttgtcgaatcggtactaaatggcgaaccgaaacacatggtactaggcggtaaatccggaagcggaaaaagccatttatctatggctgcaacgtgggcaattattgaacagtcggattacacgaaaaaatgcttgttcattagttatcgggaatttttagaacagattaaattttcttttaacgacaaagaacttcgcaaacaaattcaaggatcactcatgaaagacatcaaaacagccgatctggttgtggttgatgatctaggagccgagttgggtggaacaaaggcgggtgagagtacagcattcactaatgacataatcaactcaatttttgaagctcgtcagaaccaagcaacgatcattacaacgaacttggttgggaaagaaatggggaaggcgtatggccagcggatcacatcaagaatttttaagaactcagaggaatgttggttcctgttctctaaaacagcagataagcggctagaaagggtgtaaatatggtcaaagatatcaagagagcgaaatatggcaacagtaaggtgttagtagatggcattctctttgattcaaaagccgaagccagatactacaaaatcttgaaacaaaaagggatgagctttctaccaatatcagataatttttgcgaaatgcaaaaaaatatgatcttgcaagagggattttatagtgatggtttgaaggtagctccaatacattatcgagcggatttcgtcatttatgaagaaggcaagctggttaaggtagttgatgtcaaagggtatcaagatgcaatctcgatgttgaaaatgaagatgtttgctaaccgatacgggttcccagtgacattcgcaaagttcaattctaaaaccaatagattcgaggaaatgagttgctttgaatcagctcgtcagcaacgcaaaagagcaagcgatcgccgcaagagaaaattggagggaaccaaatgatggagagctctaaagaatggaatgttcaatttctggacgtaaatggcgatgtcaaatatcaaatcagccaaacctgtacagaatcgaaagcagtaacacttgctcggaagctagagcagatgtggcgaatacgaccggcaaacgatcggagtagtaagaaacaatcgaagctagttgcagttcgatcaagaaaaaatcttttgtaaaaaacaaattggaggaaaataaaaatgactaaacaagtaaactttcgaccagaggtaaaaaaggctacatcaaaatctaacggaaacgtagaagtgctactagtggtaaacaacggatcactgaaaggccgctatgacgatctgagcgactttttaggcaagacagtatcagttacgatccaacctgaaacagtcggctacacgcttcctatcaataaacagactaaacgtccgaacgtcaattatgcagtaaatagcgatggaacaattgaagtcttgaaagaagaacaaacttctttagatgtcggtgatggcgttgaagaaattgaaatggttgagattcaagtttccaaagaaaccattgatgaattcattaaaaatgctacctcattgccattaccggacagcatcacaatcaatcctcgtgatgtattaattcaaatcgaggagggcgagaaaatttccgaagtagctgctgtttatgaaatgtctgaagatgcattgattgatcagattgaaatctctcgtcagtacttcgcaccattcgctgatacttggagcaagaaaaaagatgaagtgatcttcaaagaattatcaggtgattcggatggggaagagtgacggcaaaataattattctggaagatgcaaaattctattggagcgttggcgtgattaaccaagcaaaagatctttttgaaaagggatttaagccatcacaggtagcggaaattatgaacgaaaaagtgattgatatcgggttagtatatctttatttgctggaaacaaaacaattgagaaggtgatcgtatgacctgcagcagatgtaaaggtgaacgtatcatttgggggaaagataaatttggccgggcagtagcaatcaactgcccggattgcaatagaaatggaatcgcggttcggaaagaaacaaaggagtgggaacatgggcatcacggaagttttctgggcaaacgttgattggcatatgaaaaataaaaatcttgttttaagcaaaacgcaaatgattgctaaaagcaaaaggactagcgtcacacttaggacggttggagaaatcgcaaagaaattggatattgatgattattctattttgtttgagcagttggatgatgaaatggcaagtcagcaattggaagaaataaaaaactaagaaaaggggaaaagataatgattgaatatcatgctttagaagacctaaagaaaaaaattgttttcaaaaaaattgtggattgggattccgataaattagttctggaagatgggacagaaaatacaattgaatgctctgaacaggattgttgcgcttgggctggtggatcatttacagatgtgaaattagatgccgttattacagatatacaaattcacgacaaaggacaaaatattttcaatggtgacggtcatgattcctatgcagatgtaattatctatcacaatcaaaatgagattgctaaagcagagtgcgaagctaacgatggaaatggcggatattactatagcatttgtgctttgagagttaaagatatgtggtctgtaattacacaggcatagtcggctatccaccaaaataaccaactgaaggagttttagcaaatgttaacttttgaaaaagtgcaacaaggaaattttgaacttgtttacaagattccgaaagaagtaggacaacgttacgaagaattgacttctttttaccgaggaagagactttaacaaggagattgaaagttatatcgaatcctttgtaaatgactttagatcattcgtcacaccagaaaatgaaaaagctctggacgaaaggcttgttaaatacaacaaattggtagttgagttgcgaaccaatattttgaaagcaacgacaattccatctgtaatgatttccggcggtgcaaactatcccactagaaagaaaaaacgtgaacttgatcgcattcatgagttggaaagggaactatacgccaacgatgggaagcatgaaagatttttagataatacaagaaaaatgtttgatccagttttgatcgaacaaagagaaaacgtagaagctaaacgaaaagctaaagcacaagaagaaggctggcaagcattttatagcgaacttaaacacgaagaaattgctggttatggcatcgatttagaagagaaccgaatttacatcgtaactaacggaaagccgtccgaggatataagaggcttattaaaatcagctgcaatgcgttggtcgcccaaaaataaacgatggcaaagaattttgaccgaaaatgcaatacgagcgattgaaaataagattctcattccgctcaaattatctgaataatagtcagctatccgacgaaatagcagaaagtgaggaagagtgatggaagatcaggtaacaattccagatgttagagaagccatcaaaatggcaagggaaatcacgccgattatgaacaacactgaatacgccacattgatgatcttttacaatcaagttttgaatcggtatcaaaaagaagtctatccagacggattgccagaggaaaattaattccgcaatcgtcagcgatagctgattgtcagagaggtgataaaaatcttagctactgactatatagattctcataaagataagaatgggaacgtgccgatcatactgaattgtggtgtgaagcataagaacagaattatagtcctaaaggtatcagctgattttgcaaagtggatttacttaacatcgggaacaggcgcttactacacaagtgcaataaggaccgttgacaaacaaaatgtattcggagtaacagaattatatgcggatcattttccaaacttgagaatagaggagggataagatggtaccaaaatttagaggtagaaatattgaaacaggggaatgggtgtacgggcatctattttactttgatgacggtcgacacttcatcagcccaacaggaactgatgttgtaggaggatatggcggagcgccagctaagtatagattagaaagtttaatttgctttgaaatcaaaccgaaaacgcttggtcagtccattggtttggaagacaagaacggcgcggaagtttttcaagatgatattgttagatgtagtagaggttgtcctcatgaggtggtttggctacaggaatatgctggcatgtatgttggtggaatgcctgcatggtatctttcagggctaagtgaaggatatgcgtggactggcgaagaggaagttatcggaaacatctatgataacccggaactgtttgagcaagccaatgaaaactagccaagcaatcatattgatactgctgacaatcgcaggtttgagtttgctatcctatacaatagtggaccaacaggaacaaattgaacagttacaagaacaactgcagcgtgagcagatgaagtacaagattattataaacgatccgctggtgagagatgctatggaagcagggggataaatgatggactttgtagtgttagtagccgtggcactttttgcggcagtattcgcaagtgtaattttcggtaaggaattagatgaaaaggagaagcaagccattgccaaagaaaaaatcgaaagtaaaaaagaagaagcgtaagttactagaaaaagccaaggcgaacggaaccataaataaaaaagtccttggtaagactttgaagagtttgatcattgatgaagaacatcaacatggctcacattttgataaataaaaaaagccactaccttttgggtaagtgacctgtgacaagactattttaccataaaggggtggcgtttgtgagatttcaatggcttaaaaactaccaagacttagaagaacaaatactcttcatgaaatggaatcttaacaagagtaggttggaattagatcgatgggtcaacggtgatttagcaaacgtgcgccttgaaaagaattcaagatcatcatcgttggaagaaaatataagaatcattgagaatgaactagagatgcttgagaaagaaaaaattgagctgttggaattaatcgattctttcagcggagcagacaatcaaattgtaaaattaaagtatattgatgacatggatgtttatgatatagcagatgctactggttacagcgtatcttatatcagaaaacggcatacagagattcgcaagacattatcattcgtggatgagtacgaggcaagacgagaggaacgcttaaagaagcaagaagaaatggactactattcagcagaccaggatcagttgagcttgttttgacattgccacaaaatgcgacctcaaagcctgtgtatatttcttgatttaaacgggttatagtaatagcgtagaagaaccggagagccggttattggactactcacaaaattctaaaaaccgaaagggggcaaatcccctcatcgctcattcttcttaacttgaatagaaagacagcacattaatttgatggaggtgattcctcttttcaaaattcgctagtgctgtctttttattatttctataatcggttatcctttaagtataaatttataaaggagattaatgattatgggagaaaaaattgatgcaatcaaaggatttttatttgaaaatgttctatctgttgtttctgaacaaggaaaagatattttaaaagaaaatgtcgtacctcttataacaaacgaacttgcaagacaaggtggtgatattttgattgattatggagctagtttgataccaggtataggtggagctataaccgaatttagaacaaacaaaaaaattaaaaatttagaggtaatggttcaagctattagcaaaagagatgaagagctaaaagaaaaattcgaaaaacaaactttgaagaataaacaaattttagatgaaatttttgaaatggttatgagaaaaattgaatctaccagtcaatcggaaaaaattgagtttatgatcaatggttattcagaattcttaaatttggataatccatcttttgatgtggcttatttatactttgataccctagataaattgactattttagatatttcggttcttaaattatcttatagagctaatacacttgaggatattgacgggtatagcaattatgaagagttacttaaagcttttgatattaactacgatcaatatgttgcaataagggagaatttaaatagattaggtctgatggaaaatgagtatgatgataagcttgttaaagatataaataatcttcaagttgcaattgatgaaatcagagggtctacggagagtatcataaaagctttatctggtgcgagaaatgctaaaattaaaaccttgtcaaataaaagtaaagttagactaaaagcgaaagacagattgaaaatatctaaatttggcagagattttattcgattttttattattaataatccaaatgaataatttttatctaccttagagacgttgtgcaaaggagtgtgattttaaatggctgtgagaggccctacaaggcaacagaaacttttcgtagataattaccttaaaaaccgaaaaaagaaccagacgcaggctgccattgaagctggctatagtcctgcatctgcgagctcacaagcttatcaactccttcaaaatcctatagttttagaatatcttgaaaaacgagaaaagcagttggaaaaggaattgaaacgtgagtttttctttgatgctatagatgctcgaaaagtattatctgatattgtcaataatccggaaagcaaagatgcagatcggattaatgcagcgaaagatttgcttgatcgtgctggctacaaagcagttgatgtccatgagatccaatctactgttaacatcaacgcagacggattgaccgattctgaactggaagaacgcattgccgagcttgaaaaggaattagcatcggctagtgatgacgatggataaaatacaaaaataccgttacttaaaagaattgaagcaattaaaacgagagaagttgttacgccaagcgcgtgatgacttcttttcttattgtcaattacgaataccagacctctataagagtgacaggaaatatttgaaagatctttgccaggagtttgaggaattcatgaagtctgatgacgacatcatgctgctcaatctgccgccacgtcatgcaaaatcaacgactgctggccgttttgttgagtgggaacttggaaaaaatcccaaattaagagttgctactggttcatataacgaagatatggcgaccgatttttcaaaagacgtgagggaaaacatcgctgaagaaagagtaatagatgatcaaattgtttatacggatatctttccgaaagcaaaattgaaacaaggatcagcagcagctaaacgttgggcgctacaaggaagcaagctttcctatctggcgacatcaccaggaggatccgcaactggtaaaggctttgatttactcatagttgatgacgtaatcaaagggattgtagaagcaactaacgaaaatgaactacaaaagcattgggactggttcacaaaacaaatgctttctcgtgttgaaaaaggcggaaaaatcatagtcattatgactagatggcattcgaaagatctggcaggacgtatcattgatgaaatgcctgcgatgggttataagttacgcgttgttataaaaaaagcccttcttaacgaagaaacgcatgaaatgctttgcccagacattttatcttatgaagatttcaaaaagaaacgtgcggcaatgggaacggcaatcgcaaatgcgaattatcagcaagaaccgattgaccaaaaagggcggctttatcaaaagtttcagacatatgataaattgccagacaacgtcattaagatttggaactatacagatactgccgataaaggtgcagactatttatcatctcctgtttgggcagaaacatccgatcacaaggcttatataattgatgttctttatacgaaggaaccgatggaagttacggagaacgcgcatgcgaacatgattgctagaaataaagttaatcaagtacgaattgaaggtaataatggcggccgtggctttaaacggaattctgaaagaaaagcaaaagaaatcggatattatggtgcgtattgggaagacttccaccaatcagcgaataaacaatcgcggatcctgtccaacagcgcttgggtcgaaaacaacgtctactacccggaagattgggcaattcgatggccggaattctatgaagccatgaccacttatcagcgtgagggtaaaaacgcacatgatgatgcgccggattcagttacaggtatcgccgaaacacttcaaatacaaaatcctcaaagcttagaggaacgaatggaagcagccaaattcttttttggctagaaaggaaaagagaaaatggatagtaaaaatattacatttttaagaaaccatcgctaccacaagaacgcaaattctgtttttagaatggcacaagaagatttcgattcggtggaatttgattgtgagatttggatttcacgactagaaaaattcattaatcgacatcaaaatgaacaagtacctagattgaaagaactcaagcggtattctttatctgacaacaatatcaagtaccgtcctgctaagacggatgaatttgcagcagataatcgtattgctagcgattttgcgcgatatatcaccatttttgagcaaggatatatgttaggtcaaccaatccaatacaagaacgatgacgataatatccaagcgcacattgacgatttcaataatagaaacaatgaaacttatcacaatgtattgattaagacggatttatcaatttacggcagggcctatgaattggagactacagtgttagacgaagcaggaagtgcttatgtcaaattagtaaaattaaatccggaacagacctttgttgtttacgacgatacaactgacagcaattctttattcggcgtttattattacacactggattatggtgacggtgttcgcaaagattttattaatgtctatacgtcagacatggtctatatgtatgtaaacagcaatcaagataaaaaaggcatgcatctagtcgattttgacgattatgcatttgacggtgttcctgtaaatgagtttgcaaacaatgaagatcgcactggagcattcgaaccagttttagattcgatcgatgcttatgatctatcacaatctgaactagcaaattatcagcaagatacaatggatgcaatccttgtaattgctggaaatccatatacaggtacggcacaaaatgacttggacgaagaaggaaatattgttcctaactcccggcttgctatttcattagcgttcaaacgtacgaaattgatgtatttggatgacaaccctaatcctaatggcgcgcagccaaacgccttctacttggtaaaggaatatgatactgaaggcgctgaagcctacaagaaacgcttagtgaatgatattttgcgcttcacatttactccggatgtaacagatgataatttttcaggtgtccagtctggagaaagcatgaaatataaattgatggctgcggataatcgtcgcgtcatgcaacaacggttgtttgaaaaaggcttaatgcgacgtctacgcctagcggtgaatatttggcgaatcaaaggcaatgattctattgcttatgatcaaatcaatgatacgaatatcatatttacagccaatgttcctaagtcagacagtgaaattgttgcattggcaagtcagcttgtggggcaagtttctgatgagacactctttgaaattctgaaaacagtcactggtgtagatccagaagttgagttggcacgaattaaagaagaagttggggagaagccattgccaagacgacctgaaacggaggatgaagacgatgaatgaaaagcagttaaaagaactaatgaagatgaatgagaacaatcaaacacttgaagccactttctttgaaatgcaacgcagtttagagtatatagctaaacaaggtaaatgcttatttgataattgtatagcggaaggatttaacgaagaacaagcattaaaatttacgattggtattctaactggtgccgcgaagtaaggagctgatcctaaatggctaaactcaataaatcaccgaaatactggtccggtcgtatggatgaaatcatggcttatgttgatcgaacggatatcgatttcttcgatgagttgcagatcatttacacagaaggccgtcagaacatccagaaggagatttacaacttctacgctaaatgctccaaagaaaacaatatctctattcaggaagcaaagaaacggctcatgcgagaagatctatctgattatcgagcgaatgctgagaagtatttcaaacaagctgaaaaagatcccgaactattgaagcggctgaatgagcagtacaaagccggaaaggtgacacggcttgaagcattgcacctagatatggaatggcacttaggcaaaatgagcggagcattgcataagtcattcgatcgatatctaaaagaagtagctcaatatgcctatcgtaaaataatcggcggaaactctaaaagcacattgaacaaagctgctttggaacagattgtaaaaactccatttaatgggaaaaattattcttccagcatttgggggaatacagatgatcttgccaaagacctaaaaaaagttcttactcaaggatttattcgtggatctggtccagcagatatggctcgtgaattgcgtaaaaaatacaacgtggccaagaacagggcagaagcgatcgtgcgtacagatggaacaaatgttgtgaatctatcagcagctaaacgctttgaagattttggattgaccaagtacaaaaacaatgttcatgttgacgatcggaccactgaaatatgcttgcgagtaaatcgtgaagataaaacttttttgttagttgaatatcaacccggtatcacagcgccaccttatcacgtgggatgccgaactggaattgttccggacgattcagaaataggttatgaagaataggagtgatatctatgatgatgaaatttgtcctaatgcttgttggagtgcctttaatagcattatcgttggttattacaattacaattttaaaaactggatggaacataattaataaaaaagaaccacctgattttgatacaacggaatccaaaagccagcatggcggaaagtgatggtgatccacgtatctcgcagttatgcgttaaatagcgattataggaggtacccatgaatttcaaagaattgaagcgtaagaaagaacgtggtgtgagcaatgaagagttcatggatcaatcaaaagaattctttaaagatgcggaaagtattgttgtggttggtgtacatcagaatggaattatctcgtccttttacacacaaagtacgtccctcaacgctatcggcatgatggaagtagcgaaacaacaactaatacaggaaatggaagcctagttactgactaaggctttttattttgtccaagcgtgatgacattaaaagcatcggaagtgcaagcattgatccacgttaaaagctatggaaggagcaacatatgatgaaaaagaagttatttatgccattgaatctacaatttttcgctgaagatggtggaggaaacgacccgggagatccaacaccaaatttcaacgtggatgaattagatgaagaacaattggcagccattaaggaaaaatttggttttaaagatgacaaagatgttgattctatcattaaaaacaagaaatcaagatggcaaaaggaattagaagaacaaaaaaatgaagctgctagattggcaaagctatctgaagaagatcgccaaaaagccttgattcaaaaggaaaaagaggagttcgagaaagaaaaagaagaattccggaaagagcaattgtatgttgaaaaaggcaaacaactaacggctcaaggaataccagctgattttgcgcatcggattgctggcgatactgctgaagaaatcctagaggatgttaaggctttccgtgcagaatgggataaggcagtagaagcaaaggtcaatgaacgactagcttcaaaaagcaaaacaaaagttggtactggtgctggtcaaatgaccaaagcagaaatcatggcgatcaaagacactgctgaacgccaacgaatgatcgctgcaaacagagaattattttaggaggaaaaaccacatgaaaaatatgtcaaaatcaaacaaagagcgtttattgaaaatgcaattgcagttttttgctgctgaaacaaatttaacaactatggatgatttgggtgaaatcaagtcgattgattttgttagtcgttttgaagcaggtatcaaagacttgcttgctttgttaggtgttactcgattagagcctctttctcaagatttgaaaattcaaatgtataaatggacaactgatgtgaaaagcgggaatgttgctgagggtgaagatatcccattatctaaagtcactcgtactaaaggaccttcacatcaagtgacctttggtaaatggcgtcgtgctgtatctgctgaagcaattgcgcgtcatggtgcttcattggcaattgatcaagcagacaataagttacttcgacaaatccaaggcggtatcaaaacacagttcacaactttcttgggaacagcgccaaccaaaattaatggtgttggattacaaaaagctttagcaagctcatggggaaaattaagtacctttgatgaatttgatggagcagaatttgtttctttcgttaaccctttggacgtttccaattacttgggagataccaaagtattggcagatgcctctaatgtctttggtatgacattgttgaaaaactttacaggcgcgtcgaatgtagttgtcttaaactcagtgccacaaggtaagatttattctactgcagtagataatatcgttctggcttacttggacatgaatgcttcagatcttggtgatatcttcgtcgatttcactgacgaaactggatttatttctgctactcgcggccgtactttgcgcaacgccacttacgaatcactattcatgaatgctatggtgttgttccctgaaattcctacaggcgttgttgaagcaactatcgaagccgtagcgccaactacaacgactacaacgaccgaaggataaggtaggggatagaaatgctagaagacatcaagctgtttctaggtattcaagatgcgttacaagatccgttgcttaatttgattattgaggatagcgagcaacggatcttatccgttttaaatcaatttgctgcaaaaaatgatactgacaagcacaagactattccaacagacctgatctatattcaaagggatgtcgctatcaaacgttttaataaacgcaacagtgaggggactactgcagatagtgaggaaggtcgttcctattcttgggaaccatcttatttgaatgagtatctggatattttcgatgagtatactaagcccacaattcgtgccggcaaaggtatcacgaggttttttagttgaattacaatgatcgcgtcaagataacctatgaaagaaaagtccctggttatcttggagatgatgtcattgaagaaaaggaaacaattgaaccatgcggcaaaactggattatcaaataatgaacaaataggaatctttggaaagtacaatcagaaggcgttcaaattgcatattcaagggatccacaaaggtttttctaaaattgaatacgacggtttggaacgatctgtttatcagacgaagtggcaccgaaattcaacggtggtgattttgacatgagtaaaagcgtgaaaataaaaggcatgaagcaatttattcgaaacgttcagcgaaaagcacctcagttggataaagccattaatcaggaaattaagctttcaagcttgcgtgtggaaaaacgcagtaagaaattggcggcttgggatactggttggatgtcaaacaatatctatgccagtgtagttggtttgatgcaagcagaagttatctcgccagctgaatactctatctttgttgagatgggcactcgattcatgtttgcacagccatttctattcccagcattaaaggcagattggccaatcctgcaaaaacggcttacaaagctagtgagagggtgattgcatgtactctcctatgacagaataccttaaagatgtatctcaaaagctatctaccactggaatttcagtagaatttaagctccctgatcctgaagtcaaggagcctttttatgtgataggcacacacaccggggatgattcacctagtgctaaatttggaccagcgatcgttgatacaagtttgcagatcgatttattttatccgattaacagtcgaacaaatttagaagaagctatttttaaaacgaaagttgcgttaaacaagcgacttactcaccaagtacttattgatagctcagttggtcgagaagtctatcatgtagttttcagaatcaacgaactaataatttaggaggaatgaaacatggctattgtaaataatggcgtcaaaaaaactacaggtaaagcattgactgctaagaaagtctggtattttatccaatcagtttctgcagaaattggctcacctgcgctattgcctgcttttcaaacagaagggggcgtaacatatggcggagaaaatattgatgagcaaactaaaatggggcgtattatcatcaaatcaactgacgagcattcgattgatttgacacaatattttgtaccgaaagacgaagcgatcaaagttgtcaaagatgcaaagaaaaatggaacgtctgtaaaagtttggcgtgtggaaattgatgattctgttgctgaagaagccgaaggagaaactgatgtaaagctatatccagcggaattcggctacggtatgcccgatgatgtggagattgcggacggtgatgatcttgtggaagcttcttacacattaaacattatcggaaaacttcaagaaggtaaattcccattatcaaatgacgatatttcagcaattgaagcactgtatgattaccaaaacccaggtgaaacaactggagactacgatgatattcaaacgactacgaccacaacacaagcaactaccaccacaacgacgcaggagtaggtgagaaaaatgaaatatattctttgtcaacctgctatcaatcgtttcaagtgggaacttgaagtttgtttaactaacttgaagtcgttcggtatcaatgatattgtactgctttttagcgaacatgattcaacaattcctgcttatttagctgataaatacaatgttgaagttcacgtatatagagatgatagagaggataaaggttatattccttctatcaagccttatctgtggtggcaatacttgaaagaagatcctaaacgtgaaaaagagcggtatgtttatattgattcggatgtcattttcaatcaaaagattgatttgcgtaaaatgacttcaaaagaagatgtttggtattgcagtgattgcaaccactacctaaatcttgattatattcgcagttgtgaaaatggagaatctattttgaaaggtatggctgagatcgtaaatgtttcagtggaatcgttggaaaccattaattttaattctggtggtgcacagtgggttataaagaatcctagagcggagtattggaaaaaagtttatttcgattcaaatcgtctttatcaatactttaaaaaagtgaatagcaacattcaaaaatggactgctgaaatgtgggcgcaactttggaatatgatgtatttcaatgttggacctaaaatccacgaagaattatctttttgcttttctacggattcaattgagaaatgtaaacaagtaaaaattcttcataatgcaggagtaaccgaaaaagatcgcgatctattctttaaaggcaagtacgttgatacatcaccatttgaagatgatctatcttttgttaataaaagaaaagcgtcagcaaaatatgtggaagcaattaaaagagttagtcgttagactggctcttttttatttaggaggaatggttaaatgtcttttgatatcaaagtaaaaaacaaagattgcaatatcaaattcaactacgctttaaattttaaagccaataaaaaattgggaactaaagatgcggatggaaattctcaaaacgatggtgccgggattctttttgttcaagttctagagaaagaagatgatgctttagtcaacttgttacaacttgtcgataagaattttaccgaaaatgatgttttagaagctgtacaaaattatacagacaatcttgttaatagcggaatgggtgaagaggaagcctataatcaaatttttgctgatctgaaagaagaaatgttagcatcaggttttttcgtgagcaagatccgcaaatacaaggagaatctggagaaagctcacaaagttatagcggctcgagaaacggaagagtcgaagcttcaagcggacgagttgaagaaattagcggaaagaatcacgaaagagatctcatagtcaactgtgcaaggtatggtttaactgatattgatttgattatgaattgttacttatgggaacttgaagcaattcttgaaggcttgagtttgcgtgaattagacaaacaggaacaaaatgctatttttggatttaatttgcgctatatcttaaatgctaaaaagccacaaatgaaaaaaattattaataaaaaatcagcagaaaatcgaattaagaaagcatttgatcgaaatgctaaacaaacgaaaaaaggtaacaagcgcttggataaagctttgaaagctttggaacactttagaaataggaggtgagatagatgtcaggaagcattaccggatccattaaggctttgattggagcagatactggagactataaaaaggcaatgtcagaggtcgttagtagcactacttcggcaatgagtaaagtgcagtctagcatgactaatagtacaaatagcattgtttcaagggttggaagtattatgggacaattaagctctactattccttcaaaattaaacggattaaaaacaagcatggttgctccttttagtgctgcagggggtcaaattcaacgagtaatcgcatctatcggtgaaaaaattcctcagcccataaaaaaaggctttggagttgtctcaaaagctgcaagcgaaacttcgagcctagttgcaaaaggcttgaatgggatagtgaaaactacaacctcaattggtaccaaggttggtagtgggttaactaatgctttcaacaaagctggaacgaaagcagcatctgcactaagcaaaatgggatctaaaacaaatgatgtaacagatgccactagcggattaatcaaaaaagttgctggaattggtgcagcctatgcaatagcacaaaagggaatatcaatgatctcgggtgctattacaggattagttggagatctcaatgaaggatctgcaacgtggaaaacgttcaatgccaatatggaaaacattggcatggggaaaaaggaaattgctagtgtaaaaaaagaattacaagacttcgcaactcaaacaatctattcagcttccgaaatggctacgacatatagtcagctggcggcagttggtattaaaaacacggataaattagttatgggatttggtggacttgcagccgcagcggaaaatccaacacaagctatgacgactttaagtcaacaagctactcaaatggctgcgaagccaatggttcaatggcaagactttaagttaatgttagaacaaacacctgccgggatcgctgctgttgcgaaacaaatgggaatgtcaacgtctgaaatggttacggctgttcaagacggtacgattaaaacacaggatttctttgatgctattactaaagttggtacaaataaaacattcagcaaaatggcaacagaatataaaactgtcggtcaagctatggacgggttacgtgagacgttgacgaacaagctacagccttcttttgataagctttcgcaagtcggaatcgatgctatcagtaaaattactgataaaatcggcgatttcaacatggataagattaacaaagccatcgacagtgtgatcccaattttggatcattttatcaatgggacaaagttgtcaggtgatgcgctgaagaacatgcagagtgctatctccagaattttaccagttgttgctttgcttggtggcgcgttgacgttgagtggcgctttaccaatgttatcaaagctgacaggcgggttcattaaattttccggtattttatccggccctttaagttcagcatttggaatagtttccggtggtgtcagtggtttaattggactttttccaaaaattggcggtggactttcgtctgcggcaacggttggaatgggcgccttgggcggtatgacttctgcgatggcaacgattatgcaagttgcactagcatctataggaccagccgcaatactaggattagttgttgcagggcttggtttagtaaacaatcaattcggggatcaaattgatcaactgttaaaaatggtcacaacaaagggacctgaagttatttcaaattttgtcaaagggattacttcacagctaccgcaactaattacaagcggaactcaattaattagtaagttggccaatacgattgcaacaatgttgcctgttattgtgcaagctggtgttgatataataggttcactggttggaggagtagcacaaaatttaccatcattaattagttcagcattgaccatcattactactatattgacttctttatctagcgcgttacctcagctaattgtcatgggtatgaatttattgttaagtctgatcaatggtatcgtagaaaacattccacaaattgttagctcggtacaacagattctgcaagcatttgtgggaaatatcgtttcgaacttgccacagataattcaaacaggtattcagatcttactgaatttaattaatgggttgacagaaatgttaccgcaattactaccagtcgctttgaatgctatcttgactttaatcaatggattgatggccaatattcctcaactattaaatggtgccgttcaaattattcaagctttgtgtaattttattgtgcaaaatctgccaatgatcttacaagcagcggttcagattatccaagctttagttagcggtatagtacaaaatctacctaatatcatttcaagtggtattcaaattatcatgtcattggtagcaactatcattcaaatgttgcctagtattttagctgctggttgggatattgttaaatctcttgctagcggtgttttagaagctattcccggagtattaaaaggtgcttgggatggaatcaagaatggatttagtaatttgtgggatacaatcaccggcaaatcaaaatccaaaggcgatgaaatggattctgatacacagtcagctactcaatcagtcgcaagcagttttagtacagcgaactctagcgttagtaaatcgatgtctagcatgcaaatttcagtatcagatttaagcagcattgcttcggtggatgcaacaaaagccgctaagaatgcaaaatctaatactactagtgactattctgcaatggccagtgatgtaacgagctctttaggtagtctacaatctagtgttactagcaatatgaatacagcaacacagaacgctacaagtgctgcgaataccatgcagaacaatgttaataacagcacgtctggcattaatcaaaattctacgaaacagatcacatcaatggctagaagcgtaggtcagtctatgcagaacatggagcaaactgcttcaagtgcaatgcaaagagtatcaagtacggttaacaaaggtttttctagcgtaagtaaagcaagcacgcagtcgatgagccaagcaactcgttcaattagcagcagcacttctcaaatggcttctgcctttagcaatggaatgaataagatggtttctacagcaagaagcgcatcttcgcgtatagtatcagccttttcaagtctgcgataccaaatgaacagtatcggctattacgctggttctgggcttgctagtgggctttcgagttcgtcgggatatatttatagtgtagcaaatagtatcgctgctaatgtacgaagaacgcttcaaagggcattggatatccattcaccttccagagtcactgcttggatgggggaaatgctaggtaaagggcttgggctagggatgcagtcaatgtttggatttgtagccaaacaagctaacgagttcggatccattatcaaagcgcagcagtatcaagcagaagcagttatggttggtgatactactttcactaataaaaatatcagtaccctgactgatgaaatggatcgagatatcgcagaatcagaactcaaaaaggatgaaatctatgtccacaatgaaattgttggagataagatttacacgacagttaaacgtaaagaagcacgtgataaaaataaaaacgattattttaactaaggggggaagatcatggatgctttgatcacaaaagatggagttgaaacgaaactttcctccattgggttacttgtcactgactttcaagacagttcaccttctataaccacgaataaaagagaagtaacaaaccgaagtggatatatattctccggggcagtacacaaagaaaaacggatcgttatttcaggaactttcgttgttcaaagcgcatatgaattagaagaaaagaaggatcagataaatgggcttatcagcaatgatgagcctttttatattaccaaattatttcctactgctggactgtatgattttgaattacctggtcaaaaaacaagcgatttaaatttacttgctattccacatcaagcgtataagtatcgatacaaaataattgtagaaaacgaaatttcatatacatttgttggattatcggctgcaggtttaagaatgaaattttcctttgaaggaagaacagcagaacttccatttggggagactattccaagatcagttactgtttcatcaactattgattacgcaggaactgcaaaatgtagccaattagaatggccatggataatgaagctcacgtcgaatgctatccaaaacggtgatgtgactgtaaaagttggggatagaacatttatctatcatgctgtaacacctatggcaagtggtgatgtattgatgattaaagggatagaaacaacactaaattcgttgaatgtcaatgataaaacgaattacgagcactttattttaacaccatctgcaagtggaaaaatcgctttgacaacaaattttaaaggatcaattcaactactcaatttcgttgaactctataagtagggaggtgattgagtgattaattttattgatgaatacggtaaacaacacgctgcaattgttgagtgtcagaaaacaaagggcgtgaatggcgaaaaatctttatccggtactatctatacaaacgatgaaattttagaaggtattggtcgtggatggcgattacagtttgaagaggaaaattattgtttaacctatgtaaatcctattgacgaaggtaatcgtattgttgttgagttcgatgcggttcatgaattcttttttgatttgagaaaatctgtaatttattccgaaatgaatggttcaaatactgctaatgcctatctgcaattcattttcaatggtagtggttatgaatatcgcttagaagtaaccataccatcttttgaaaaagaaagttttggaatgaaaaatcgccttgatttattcaaagattttatttcttctacaggtgttgagttttcggtaaatgggaaaattgtccgtattcttgaaaaggttggaacaaatctttcaacaatagtaaaaaaaggattcaatttgaatgagcttaggatagaaaaggatccgggttctttcattacctatttgagaggatatggtgctttttttgatcccgatgatgaatctaaggggagattaatagttgagtatttgagtccgcttgctgagttatacggaaaacttgagggcgatcctatcgttgatgaacggtataaagttgaaagtaattttattgatcgtttaaaaaatgatgtggaaagttcttatgggatatcagttgatatcgatatggaagatttaacgaaagctggttatgaatatgatcaaccccatgagggcgattatatcatggcaattaataaggatcttggatttgaacaaaaaattcgaatcatgtcatataccacaagttatgatactgaagggaatattattgatcatgatgtatcatgtggatctgacaatattattcaaaagaagatcaatcaagaaaatgaataccgtaaggaagttcaagctggattagaaaacgcaataagtactgcaaatcaggcttggatttctgctgatggcaaaaacaaggtttttcaaggtccggatagacctacagctacaaataaaggcgatatctggtatcaggtagatggtgaacaaaccatcatgaattactgggatggcttcgattgggtgccatttatcaatccagatgctgttaaggaatcagtcgatcaggccaagcaagctggtgaacaagcgcaagctgctgctgaacaagcatctagcgatgctcaagcagcaaaagtcaaggctgatgcgattcaaattgatgtgaatagtcttgtctctgatgttgctactattaatggtaatgtgactacaattagttcgaaagcaaatgaagcgtatagtaaagcccaagaagtcgagggtaagacagtatcactcgaaaacacagtgagtggttttactggacgtttgacagacatagaaactgtgtcggacgctactaccaaaaaggtaaatgaattagaagtcacagttgatgggcagaagcaaactcttgctactgtgcaaacgacagctaatagcgcattgagcaaggcaaatgttttggagacaacagttgagggtgtaacacaaaccctttccagcgttgagtacaaggttgataacttagatcttacagacacaaatattttacccaaaagtgattactcagataatttgagtacatggactggtgatggcgctactagagaactaataagcgacggaacaatgagaattacttttagtggtagcggcaataaccgtgtttataggggaaatttattcaacttaaagcaaggggacaagttttcagtaagtttctacgcttggtcaaatgtagagggtgcacagattagagttggaacattctataataatcagactgtaactttaacagctccgggtggaggtcctggaaagtattttgagttgcatgaaataaccatgggaactgtatcaaacgccttatctattgttggaattggcacatcatcatttaatgtaagaatccataaaattatggtgactaagggtaataaagcaagaccatgggcattagccccaggagatatggcaacagtttccaaggttaatcagattgagtcaaccgttgagggaactattcaaacagtatcttctgtgaaaaatatagctgattcagccctatctaaagcaagtcaaactgaaaccactgtaaatggactgaaaacaactatttcaactgttgagacaaccgctaattcagctcttacaaaagctacgcaggtcgaaactaccgccaacggtattagacagactgtgaccgaaatgcaaggaagcattgcagacctagtcaataaatttcctgatccagacttccagaagcagaatccaaagcctacagtagaagggtatgggataactgggcaatatgatgcaagtggatttcttattgataatacctcaggaaccgctaagcaaagggtttattggggagctgcacctgttgctttaactgtcggaaaaacttataacatcaaactatacatgaacacaggaagtactggcggaacagtagaaattggctcatctgagggagaaaacattaaggttacgcctcgagcaggatatctcacatgggttcaaggtactatcaaagccacaacatacactgcttttagtatttgggtagaagccggcaaagcagtaaggctacgagaattatatatctatgaagcaaatacagatgttacatctgctcagtttactcaactgtccgacacgatcaattttaaagtgtctaaaggtgatgttatcaaccaaatcaatgtatcaactgaatcaatactgatttccggtaataaagttcacattacaggtcagacaacaattgataacggagtgatcaaaaatgcacaaattgcagacctttctgtatcaactgctaaaattgcgaatgctgcaatcactgatgccaaaatcggcagtctatcagcgactaaaattactacaggcacgttaaatgctgcaaatgttaatattattaatttaaatgcaaatagtattactacgggaacgatcagtgggactaacttatctataaaccttgctactggtgaagtcattttcaacaagggaatcatcaaaaacttagatgatacttttcaaatgaacattactactggagtaaccgcatctagaggtgaatatttatcgccaaatgatacaggtaacactttagcagcaggttataatctgatgaacggtaaaattgagttttatactggaacatttggcgaagcgactgtatcttatggtgggttgacaaccgaaacacattctggtcagtataaagaaaatggtatctggcaagctggcatgtggtcaggaaatagaccagcaattgctttgaaaatggctaatccaaatacaagcgtgtggcaatctgtacacagagccgttcttttatcatcaacagaataccaagaaccattctcgagtagtttttttactgatgctacatggttaggttatggggataaaagcggtgctgatactaaacagaatatccgtggtgctggtattggcgtaaaacaatctggatcagacgtcaacaaagatgagtctggcggtttgttttcggaagcttgggttatagcgagacatggtgtttacttagctagcggttatgcctatgattctacgattagtggacgcagatatttagcacctactattaggctcggtaccacaagagtaaatagtggtgctactgaaagcattaagcaaatggcttcaacagcaacgataactgctggatacaaaatagctatgcagtcgaaatatattgacttatgggctggtgattccggagaaataactctaaatgcacaacgtacagatataaatggtggcggtgattcctcgttatatggtggtataagttttggtgcagactctaatggtgcccgtgtatggtctaaatcgatctataataaaacctattcaagtgggccgcaagtatgcgtcacaagttacgggacccttggtcggattacctctgctcgtaagtataaaatgaatattcaagtagctaataagatagtagctgatgccaagaaaattttggaaatcaatccagtatcatggattgataaatttgaattgagttcggggaacgtaaaaggccgatactatgggtttattgctgatgaatttcacgaaaaagggatgacagaagttgtattctacgatgagaaaggtcaagttgaaggattggcctatgatcgattgacgatgtaccacaacgtaatactctctgatcacgaacgtgaagttcaattgctgaagcaagaagtggaacaattaaaaataagaatacaggagttggaagctgcttagtttctaactcctgttttaatggaggaaattatatgaaaatcacattgaagaacaacgagttagcaccagcaatcaattttttagaaggtatgacgcttaaagcgaataaggacagtcgacaccgtacaaagctggtaaaacgtattcgagaagcctttacagagctttctgatgaggaaaagtctctgatggaaaaattcaatctgcttgatgagagtggccaactcaaagagggcaaagatcaagatgcaaaagatgtggctgctttcaataaagaacaagaaattttgatggatgaagaaattgtgattgagggcggtatgtatgcgcgaaactttgatgaagtcccacggattttgaatgagtacgatggcatgttatctggtaaagatgccgagatctatgatcggttgttagatgaatttgaaaaagaaattgctgaatagtcagtattattaaataaacaggaggaatttatcatggcattaaatactaaaaaatcaatcagcattacaggagaatcgaaaattaatgggcagcaagttatttacctaaatgctaatgtcacaacggatagtgctggaaatacaaatattaaccaatcgattactgaccaaaatctgtaccgtcaaaatcgcgtcgaatgtcgtaaagatattgatgattttcaagcaaaggtttgggcaattgaggatgatttattaaatgaagtggaggagcaggcgtaaagcttgctctttttagtttatgaaagcaggtggcatatgtggaaatagaaaagcaggtccaagcgcatgaggagcggttaaaacagcatgacaaagagttggggcgtcttaatgacattacattagaaatgcaaaagtcaatgaacgaaggacttgcacgagttgatgaatcaaatcgcttcttacgtgagcaaaacacacgacagagcgaacaaaatgctgaaatcctgcgtgctgttttgaatagaaatgaaaaatcagaagaacgggattatgaactaaagatggttgataaaactaacatgtggaaaatgatccttggtattggtgcatcagcaggagctgtatttgcatttgttttagaattaatcaaattttttggaggtagataaacatgaacaacattaattggaaattacgtttgaaaagcaaggcattttggttggcagtgattccagcattggcattagctgtgcaagcaattgctgcagtatttggatttgagtatgattttggcgacctggttaacaaactgatcgtagtagtcaatacagtttttgcagttctggtgattattggcatcgtcaatgatccaacaactacaggtattactgatagcaagcaagccttaacctatgaacagccaaagaaagatacagtcgattatggagatggccaagaattcactgagcgaaaggatgattaaaatgagtattccaacaccagttattttggatattagtgaatggcaaacgccaaacactatcaattatgataagttggccagtgctattgacggtgtaattgttcgtatacagtatggatcaaggtatatcgacaagcactacaaaactcatattgcagaatttcaaaaacgtggtgttccagtagcggtgtacgcttgggttcgaggagtttctaattcagatatggagaaagaggcgatagatttctacaatcgtgctaaagcatataatccaacattctggtggcttgacgtagaagaaaaatcaatgagcgatatgagaactgggattgaaaagtaccgaacaaaattgaaatctctaggtgctaaaaaagtgggggcatatattgcaaaccacttgtatgccggctttaatttagatacttcaaaatttgatggtatctggattcccacatacggttcaaacaatggccagtataatggttcgaatcccacagctacttctaactatgatctccatcagtacacatcaaatggaaaactaagtggctattccggaccgctcgacttgaatcggattgttcgcaaaggatttgaatatctttttggtaagccttctgctagttcaaacaacaatgggtcatctaataactcgacgataggaggaaaaataaaaatgaaaactgtaactttaaaagacaatgttaatttacgtgttagcgcaaatactaatagcaagattattgcaaccttaaaaaagggcagtaaagttgagtttaatgatattgtaactggttcaggctatatttggggtgtacaaccgcgaaatgattcttacaagaaggggtatattgctataggtaagttgtcagattggggaaatattctataatatgcaaaaggcccactcgtttgagtgggcttaatagttctatttaaagactatgtgggttaaaatcatgtctattaatattatgtctattacaatccacaatgttaccctacccctaaaaagagaaacatcttcatggatcttctttctaacatttttaactcccataaaatcactccttatccttttcacaaacaggattatcaataatttcatgatcttctgtactttgtctggtccatgtattaaccatcagaacaaaataaaaaaacaatagaattccccatgctaatatcactaaccaaccatcggttaaatgaagcaaccatgttactacagcaataagtacaatgagcaggacagaatattgaatagtttcttttattcgttcttcttttgttgtcgggtgggaaccagttacaatagatattttcttgttcatgttaagcaatccttttatagttctaagatctcttttttcttcaactcaaattcttcttgtgtaataatccccaaatcaagtaattcttttaattcttttaatcgttgtgtagaagaatgttcatttgatttttcaacagtagtatcttctgtataatcaacatttgcaataaagcgttctaggttactcgcttgtgccgactcaagaaaaacttttatttcttctatagagccattttctaaatttcgtaaaaatattttcccttcactgccaacttcttttatagttgtggttgatttagtatcaaccttactttttcgttttccagcactaccaataattgctcctgctggtcctaatagtgccgcaccagcaatagtttgtcctgtcctaccttttgttttaatattacctgtagttgttgtttcttgggttatagtgctcccattccactcaaaacgctcaaattgatatttagttgcatttggatcatattttttggaaacgtaaaaataatcattaatatctcgtcttaaagtaatcgaatctaattgtttcataaatggttttttcacaggcaagacaatcttttgttctttcttgttttcttgatgattagaaagagcggtactagctgcattttcaattggcttcatcatattcccaatgtttttaccagcaatatctttggatttcaaattatctatttgttctgacatggcttttgtagctttgtcttttaccttatcaaacagtcccattttaaaaactcctcacttttttcttttattgtatcagaaaatattgtaagaataaaaaacatttcaacgataaaatcgtttattaaccgaagatgttatttttttagaacaataatattgggggcaaaaaaggggcaataaaatgataattcatgataattagtgcaattatattttatctagaaacagcgaaaattattgctgtgatagtaatagatagtccatatacattggttaagtattttaagcaggagtctccatgtgtctgattttttttaattaactattagctgatgaaaatcagctttttttgttgccaaaaagcagaactgcgacttctctaagtgagttcttctgagggggtagacaaacgccctttttttatatccttcattcaataataaataaaaaaaggggctgtgccataagtctcctacaagtgaaatccgaacatgatatagtattgctcttgcggtgcaggggttcctcgtcgcaaaagtcagaggaatctatcgcaatagaatatgatacggtttcacttgttggatgatgacttatggcataacctcttgctaaaaagtaactactggaatagttatctgtctaatctcatataaattagtggatatggattgccttgttcgtcaaacgctgtttttttataaacttcaaatcccatgtgttcataaaaatcttttgcaagcgggttttgttcattcactgctaaattattaaccaaatatttttctatgccgtatgtaagcaattctttgcctaacccttttcctctttcttcgttagcaataaaaagcatttcaagatgttgctccacgatccccataaagccaacaggtgcttgattttcgttttctatgagaattaaataggggatttcttttaatgcttgtggtacatacgtcttgatttcttctatttcatgatctgatagaaagagatgcgttgctcttacagcactttcccaaatggttaatagctgttctatcaatggtgccgttctttcttttacctctataattttcaagttcttgacctccaaaacctccgatttttttaattatattaaagaaaaaagataaaaacgaagtgctgtatatccaacagatatacagcacttcatgacacgaatgaagttagttgcagtctgagaaccactacacctataagcgaggggttctattattgtttgtagcagatcgaattagatatagtcttcatgccgagggccattcctgcggatctcttcttgttcttcagcggataattcagtgaagatatcactaccgtctaaaaacgtgttccaatctgtccccatcatctcatgaagtgtctctggatcctcgtcggataaacgatgggaggtctctccatccaccgtttgttgtttctcagaggaagaagtgtacttgtggccaaaaagtttttcccactctgctcgtaactgttctaacatcgaaatccctcctttttttttattgtagcacaaggtctttagaaaggcggtccaaacgctggaaacaaaacctgaatcgaaaagcatccctctggtacctcgcaaaaattgtgctattctaatagtagttggaacattaagctgaagacttatcaaatagccgacagcaaatgggtgagaagagggataagatggaaaaaattacgctagtacacacgaatgatttgcattcacatctggagcattggcctaagatccgccgttatcttaatcaacggaagcaagaagcagattcgagtcaagaaacagtgatttctttggatctaggagattttgtggatcggtggcatccattgactgaagcaacgaacggacaagccaatattgagctgatgaaccaaggacactatgatgcagtgactattggcaacaatgaaggtgtgggaaattccaaagaagagcttcagcatctttatgatcaagcggagtttcctatcttattggcgaaccttttcgataagaatgatttgaaaccaccaaaatggcggcaggattaccagatcatcgaaacgaatcaagggacgaaagtcgggctgattgcttttacggcaccctttcctttgacctattcaccaaacggctgggatattcgtgaacccttggaattgctgcctttattgatcaatcatttgcagccccaagtcgatattttagtcttgatgagtcatttgggaatcaatgcagatcgagcgatcgcggctgagtttcctcagttggatgtgattttaggctctcatacgcatcacttattcgagaccggcgaaatcgtcaatggcgtacaattggcagcagcggggaaatttggcttttatattggtgaagtaacgattacgttagatgatcaagggcaaactatcgagcgttctgcccgagtgatccctacagagcagcttttagcttttccgcaagatgaagaagagattgctggttatctttctattggtcatcgtttgctgaaaacgaaacaagtcgcacaacttccgtgggcgcttcgttgtgaagggaacgaagattcgattatccaagaagcattggcggcgctttgtgttagaggacaaacggaagctgctgtgttgaatagcggtttgtttttaggtgatttaccggcagggcgcatcgaccaggatcaactgcataccatcttgcctcatccgatgcacttgattcgagtgacattgaagggagcagatgtgatccgttttgttttagaaatggaaaaaaatcggcgctttttacggaactatccaattgttgggatgggatttcgtgggaaaatatttggtgaactggtttataaggggatctcttatgatgccatcaatcaccaagtattgtggcaaaacaaagtaatcaatccggtggaagaataccagatcacattagtggatcattatttgtttattcctttttttcccacgatcgagatagccggacgctgtgaatttttatttccagaatttattcgtacggtctttggcagctacttagcacataaatatccgatccagtaatgaaaaagtcggaggggaatctgatacaagcacgactatcattacgtattaaaacaaggtataatagacaacaggtggtgaaaagatgaccgaaaaacaaacaattacagacgagatcacttcggtactcgaggagatcatcgaagaaccagagaaacagccgcaaaaaggcgaactggttacgcttgttaatgaagatgaattattgatcggtacacgccaatacaaattggtggtagattatcgcgaaggatttgatccccaaaaattgggcgaacggtacagtgaagtattggctcgctacgattacatcgtaggggattggggttatgaacagttgcgtctaaaaggtttttttgacaaagacaatcgcaaagcattaccggatcagcggatcgacatgctagaggattatttatatgaatactgtaatttcggttgcgcttattttgtaattcaacgagttggcggcaagaaagaaaagagtacgacccgacgccgtaaaaagaaaccagcagctcaaatcaatcaaacacgtccggcacacatcgatgagaaacaagaagttgtttctcaaaagcaggtgaagccaacgattaaaaatcgaaaaccaaaagaaaaaaaggcgcgatcgacagaaacgacagtgaaaaaaacaaataaaaaagaattcacgatccgtcaacgggaagagtaatttatgaaatataagggatatttgattgatttagatggcacgatctatttagggaaagagccgataccagcaggcaaacgcttcgttgaagctttgcagaaaaaggaattgcctttcctttttgtcacaaataatacgacccgcagtccagaaacagtcgcacaacgattagcggatgaattcgccattcatgtggcgcctgcaacaatttatacggcaagtttggcgacgatcgactttatgaaagaccacggtcgcggcaataaagtctttgtgatcggcgaagcaggattgatcgacttgattttagcggccggttttgaatgggatgaccaaaatccggattatgtcgtcgttggtttagacaatgatgtcacctacgaaaagtttgtcttagccacattagcgattcaaaaaggggctacctttatcggcaccaatccagataaaaatatccctaccgaacggggattgttacctggagccggttctttgatcgcaatggtggagactgcgacacagacaccgccgattttcatcggtaaaccggaagcaattattatggacaaagccgtggcacaccttggtttaccaaaagaggaagtcattatggtgggagataactatgagacggatatttgctcggggattcggaatggcattgattccctattggtactatccggttttacaccgaaatctgctgtgcctcgtttaccggaacccccaacttatgtcattgattccttagatgaatgggattttgaccaatgagaaaacaagtatggatcgagcggctagggatgctgtgtttgtttttatttctgatcagcttagcaattacggtaacgatcaattttcgctggctatatcattttgatattcaacagttgaatattttagattataccgacatttcaaaagaagaattgataaaaaattatgggttgttgctggatttcttgaacaatccattgaatacgacattagctttgccagattttccgatgtcagcggcaggagctggacatttctatgatgtgaagaaactatttttattaaactatggtgtactgctcgtaacgttgatccccagtttcatgcttcttagatctttttggaaaaatgaccagcgctggcggttgttgcgaccattgcagtgggggatgctgctgccgattttctttggtttcttgatggcaatcgggtttgatcgattttttgtgacgtttcatgagattttcttcaataatgacgattggctttttgatccagtaacggatcccatcatcaatgttctgccggagacgttcttcatgcactgttttattttattttttgtactgattgaactgtttttctttgtgatttactggtgggcaaaacaaagtcaaaaaaagactatttcataagtgagaaaagacctagaggatagcgggaacgtcagtcatactggcgttccttgctagtatcgcgtaacgatttacacggtagtcccttcaggtgtttcagacttgtgggatagtcttttttcgatagtagctgatttttacaagtttattgagtgatgtaatgagacttgcttggatgctggtgcgccaaacgactagctgccgaagctgcgattgcacctacaatatcatctaagaatgtatggacccgggggccttcatgactgtttaattcttttaaaatacctggcttcactttatcgatgtagccatagttggtgaaaccgatcgaaccgtagacattgacaatggaaagtgccaaaatctcatcgataccatacaacccttcatcatctttgacgatttcctgcaatggatgcaaaaggctgttttcttctgccaatatatctaactggataccagtcaaaatcgtgttgtgaacctcacgtttactgaggactgcgttcacactttcaatgcacatatctaatgtaataccttcgatataatctttttgtaaaaataaaacaagttcgccgatatcctgaagtgatacgccgcgctctgaaagtagttctcttgccttatcttcaagtgttttattctctaataccatgtgattccctccaattcttttttcttacttctatcctatcttatcttgcccgtggaatcaaaaaataccgacgaacagcaacgtagtcgtttctgaactgtatgaaaaaaagtcgcagagaaatcctgcgaccgttctttttatagcttttttccttttttatactagctcttttttaagctgttttttaatatagtagtttttgctttttttggtttttttaatatagtagtttttgcttttttggtaagtagctttttttgcaattgttgttttgcggcaactgcccaagggtgggccactagcaaatcaccagcaaacagccagtcaagataacataatgctgccgcttctaaagagttatcaagtgcagccagtagctcctctaaaaaaggtgccgcatctgcgcgatcccattcgattttatctgctaggaaaacaatgagatccagctttgaaaaattttccttaagtgtcgtgtggcaggtaatggcagacaaaatctcagggtcagtgatcccaaagagctcttttgccaaagtagccgattgtttttgatgcagcaataatggtacttttctttcttccggcactatctccaaaccgtaatattcttgaaatgcgagacgttcatcattgggaatgaccacgctgatatcatgaaacaatccagcaatcgttgctttctggcagtcgccaccgaaacgtttggcaagttgctcagcggcattggctacttcgagatgatgttggacagtcgatacttggtcaaaggcttctaagtaaacacgcatttggtttgcaagggacgcatcaggtaaatcaattttataccgactcagcatggtctactccttgaacaaactagtgctgtgggcaggttgtgtccggtttttaggatcaatgtaatgaagcgcattgttgacggcagtgggggcttccccgaaaccagtagcaatcaaatctactttgccatcgtataagaccacatccccgcaagcgtagattcctggaatggatgtccgcatatctgatgtaacgaatacgccttgtcgagtgctttttagtccccactctttaatgttcaaagtcgaagaaaaaccgtaattaacgatcaaagagtccacttgcaaggaaacagattcatctcctttgacttgctgcaaagcaatttcagttagacgtttttctccactgatatcctggataacatagggagttagaatgttgacagaagaagcgcgcagtttgttgacactatgttcatgcgctcgaaattctgggcgacgatggatcaaataaacttcactagcgattggttcaagcatgagcgcccagtcaatcgctgaatcgccacccccagcgatagcaactttgcggcccgcatacttcatcaagtcagttacgaaatagtcgagtccattgccttcaaaacgttcactgtcgggtatagacagttttcttggctggaaggaaccattgcctaaggctaaaatcactgctttggaatagtgattgcctttatctgtgatcagttctaggtagtcttcgtgcttttcgatctgtaagacggtttcctccaaacagtattgatgattgaaggtagtcagttgcttttcaagattttgaaccaattcaccggctttgatctttggataacccggaatatcatatatatatttctcaggatagagcgtggccaattggccgcctagctgaggcagactgtcgatcagtttggtttttgcgttgcgcataccggcgtagaaggcagagaacatgccgctcggcccagcaccaacgatggtaatatcatatatctccatagtgcatctccctctgttgattgattattctacagtatcacctggacgaatagcttcattatagcaaaaattgtcttaactagcattttttcatttttctgctatcattgttttagtatttagtataaacaaggaggcgttaagtgtgtctgaatttccacagctacatttaaaagaaacaggtcataaagcagttatcaaaacgaatcggggagatatcacagtagtgctctttccagaattggccccaaaaaccgtgaaaaacttcgtcgaacttgcccaaaaaggatattacgacggtatcattttccaccgcgttattcctgattttatgattcaaggcggcgatcctaccggtactggtatgggtggcgaaagtatttacgggggcagcttcgaagatgagttttcaaaagagctcttcaatcttcgcggagcattatcaatggctaatgccggcccaaatacaaacggcagccaattctttattgtcaacaatcaaaacgtaccagcgaatatgcttggtcaattagagggagcaggttatccttccgaagtgatcgaagcatatcaacaaggtggaacgccgtggttagacttccgtcacactgtttttggtcatgttgtagatggcatggatgtagtggacgaaatcgcaaacgttcaacgaggaccgcaagaccgtcctgttcatgatgttgtgatcgaaacaattgaaatcagtgcataaaaaagaaccccgcggggttcttttttattgtttcagttctgtgaatgcagcagcaatttgcaggagacctttttgcagcgtttctcgaggacaagccaagttgatccgcatatgttgcgttccggatgggccaaagttgatacctggattcaagaccacttttgcttctttgatcaatttgcgttgtaactctcggtcagaaagaccgtaggcagagaagtctagccacataagataggtgccttctggcttttgaaacttgatttcaggtaatttttctaccaaaaactcacaggtccattcgatattggctgaaagatagttaagcaattcatccagccatgcttctgactctcgataggctgcttctgttgctacaataccgaatgtattgatttcactttgaacatttttttcttgaacagttatgaattgttttttcaaatccggatttttgataaagatcattgaatttttgatgccggccaagttgaatgttttggttgctgaagttaaaacaatggagaaatcagcaaaaacaggatcaactgtctgaaatgaaacaaatgtattcggagcaaaaacgatgtcttgatggatctcatcgctgaccacgagaacatgatgtttttgacagatcgacccaattgtttgcagctcctcttttgtccacacacgaccaccaggattgtgtggattacacaaaatcatcagtttgacatggttatctacaatagcagattccattgcaacggaatcgatttcgaaatgcccgtttttttcgatcaacgggttgcgcacaagttgacgctgatttttttcaacaacgtcagcaaatggtgggtacactggatcatgaatcattacactgtcgccttcattggtatagctctgcacagctaatgcgagactagggacaacaccactgttgaacaaaatctcctctttttgtagcgagtagttgtgttttcgttcttgccaagaaatgattgcttcgtacaaactttcagggaaaacagtatagccgtaaattccttgatcaatcacttgctgcagggcattcttgaccggcttaggtgccaaaaaatccatgtcggctacccataacggcagtaaaccttcttccttataggtcgtagcaatactgtcccactttacactattggtatttaaccgtgaatggacattgtcaaaattcgtcatatgtacccctcctagatcgtttttttctactacttcaaatctaacactagttcaagtataataaaagatgaaaagagaggaaatcatatggactatcaaatcggaactattattgacggaacggtcacaggtatacaaccatacggcgcctttgtgtcgctcgataaagaaacacaaggcttgatccatgtttctgagatccagtctggatacacgaagaatattcatgatgttttgcaagtgggccaggaggtgcgcgtacagattatcgatatcgatgaatatagccaaaaaatcagtctgtcccgcagaacattagaacaaaaatttgttcagcttccttataagcgcaaaaggtattttacgaataaaaacaaacgaatcggttttcggacgattgctgaagccttaccaaagtggacagcagaagccaaagagatgctggaaaaagaaaacggaaagagataatcgtgcatattttctgaaaatgtgctaaaattgatttacaatcagttgaataaccgaggtgggtattttgggatccaaaaaagtggcaggaacagttatgatgcacttggcaaatggctcgaaaaagtttttgatgcagacgcacgaaggtaccgcagaactggcatctacagacttctctgaagataagaccggtctagcaaatattttacaattgtttaaagacagtattcatttagacgtgacagcgatcgatcttgttgaattaaccaatggatcgattgatgctgagaatattccactttttgtttttgaaacccaagaatcaggacaagacaaacaactacctgatggttatgcgtgggaagaaccgaatgttttcagacaaattattgaagattacaaaatagaaggtatgccattcttctaatcaaatggatagaagacaactacataaaaaagccgttgatacggcttttttttcttttcagaaaatttattggagaaaaacagaaaatatgcttgaccctcagagagaataatggtaaatttatcaacgttggcaaaacacaccgacagtcaaaacctttcaaaaaaactttttgaaaaaagggcttgaccaaaacggaaacagatgatattataacgaagtcgcaaatttaagaaatcaatttgatgctgatgcagcaacaaaaaagattgaaaaaagttgttgacaaataacaattcatttgttattctaatggagtcgctgatgacgcacaggaagttgttgaataaacactttcgaaaaaaacttttaaaaaaagagttgacattcgcttgttaatctgatatgatttaaaagttgctaacgcagcgcagtagacctttgaaaactgaacaaagcaagcaaacgaaccaatgtgtagggcgcttcattatatgaagcaaaatacatgcaagcaatagctagcaaagttaattttatttgagcttaacgatcctatggatcgttcaaacaaatcattatgagagtttgatcctggctcaggacgaacgctggcggcgtgcctaatacatgcaagtcgaacgctttttctttcaccggagcttgctccaccgaaagaaaaagagtggcgaacgggtgagtaacacgtgggtaacctgcccatcagaaggggataacacttggaaacaggtgctaataccgtataacactattttccgcatggaagaaagttgaaaggcgcttttgcgtcactgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtagaacgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcgaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaatagtacggaagactacacatcgtttgcctttgttcagttttgagaggtttactctcaaaatagtttgttcattgaaaactggatatcgaagaaaatcaaaacaagtaacacacaccgagttgacaagttaaagagttttttaataagttcaacgcttattttcttgagcaaccttctatcgctagaagaagtactcaccgaccgtaaggtcaaaggttaagtgaataagggcgcacggtggatgccttggcactaggagccgatgaaggacgggactaacaccgatatgctttggggagctgtaagtaagctatgatccagagatttccgaatgggggaacccagcatcttttataggatgttacacagttgtgaatacatagcagctgtgaggtagacgcagagaactgaaacatctaagtacctgcaggaagagaaagaaaattcgattccctgagtagcggcgagcgaaacgggaaaagcccaaaccaacaagcttgcttgttggggttgtaggactccgatatggtagttgaaacagatagtcgaaatacttggaaaagtatgtcaaagagggtaaaaaccccgtagatgaaatctggctcacacctaggaggatcctgagtacggcggaacacgaggaattccgtcggaatccgggaggaccatctcccaaggctaaatactccctagtgaccgatagtgaaccagtaccgtgagggaaaggtgaaaagcaccccggaaggggagtgaaatagatcctgaaaccgtgtgcctacaacaagttagagcccgttaatgggtgatagcgtgccttttgtagaatgaaccggcgagttacgatagcatgcgaggttaagttgaagagacggagccgcagcgaaagcgagtctgaatagggcgaatgagtatgttgtcgtagacccgaaaccatgtgatctacccatgtccaggttgaaggtgcggtaaaacgcactggaggaccgaacccacgtacgttgaaaagtgcggggatgaggtgtgggtagcggagaaattccaaacgaacttggagatagctggttctctccgaaatagctttagggctagcctcggaattgagaatgatggaggtagagcactgtttggactaggggcccatctcgggttaccgaattcagataaactccgaatgccattcattcatatccgggagtcagactgtgagtgataagatccatagtcgaaagggaaacagcccagaccaccagctaaggtccccaaataactattaagtggaaaaggatgtggggttgcacagacaactaggatgttggcttagaagcagccaccatttaaagagtgcgtaatagctcactagtcgagtgaccctgcgccgaaaatgtaccggggctaaatagtttaccgaagctgtggagtgcaccgtaaggtgcattggtaggagagcgttctaagggcgttgaaggtagatcgtgaggactactggagcgcttagaagtgagaatgccggtatgagtagcgaaagacaggtgagaatcctgtccaccgtatgactaaggtttcctggggaaggctcgtccgcccagggttagtcgggacctaagccgaggccgacaggcgtaggcgatggacaacaggttgatattcctgtacccgttgtttttgtttgagcaatggagggacgcaggaggctaagaagtgcagactgatggatatgtctgttcaagcagtgagtcttagtgggagtcaaatgcttctacttttaaggacaagctgtgatgaggagggaaataatagtaccgaagcttctgatgtcacactgccaagaaaagcttctagtgagaaaacaatggcccgtaccgcaaaccgacacaggtagtcgaggagagcatcctaaggtgagcgagagaactctcgttaaggaactcggcaaaatgaccccgtaacttcgggagaaggggtgctgctctaacgagcagccgcagtgaataggcccaagcgactgtttatcaaaaacacaggtctctgcaaaatcgaaagatgacgtataggggctgacgcctgcccggtgctggaaggttaagaggagtgcttagcgtaagcgaaggtacgaattgaagccccagtaaacggcggccgtaactataacggtcctaaggtagcgaaattccttgtcgggtaagttccgacccgcacgaaaggcgtaacgatttgggcactgtctcaacgagagactcggtgaaattttagtacctgtgaagatgcaggttacccgcgacaggacggaaagaccccatggagctttactgtagtttgatattgagtgtctgtaccgcatgtacaggataggtaggagccgtagagatcgggacgccagtttcgatggaggcaatggtgggatactacccttgcgttatggccactctaacccgcagcccttatcgggctgggagacagtgtcagatgggcagtttgactggggcggtcgcctcctaaaaggtaacggaggcgcccaaaggttccctcagaatggttggaaatcattcgaagagtgtaaaggcagaagggagcttgactgcgagagctacaactcgagcagggacgaaagtcgggcttagtgatccggtggttccgcatggaagggccatcgctcaacggataaaagctaccctggggataacaggcttatctcccccaagagtccacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgttggaaatttgagaggagctgtccttagtacgagaggaccgggatggacttaccgctggtgtaccagttgtctcgccagaggcatcgctgggtagctatgtagggaagggataaacgctgaaagcatctaagtgtgaagcccacctcaagatgagatttcccatttctttaagaaagtaagatccctgagagatgatcaggtagataggtcagaagtggaaggccagtgatggttggagcggactgatactaatcgatcgaggacttaaccacgattgaaaaaagcaaggaaactcggaagagttttgattcttcgatccagttttgagtgagcaatacttactcaattgaatagtgtggtggcgatagcgagaaggatacacctgtaaccatgccgaacacagaagttaagcttcttagcgccgattgtagtgaagggtttccctttgtgagagtaggacgtcgccacgctgtttcattccggcatagctcagttggtagtagcgcatgactgttaatcatgatgtcgtaggttcgagtcctactgccggagttatcgatagctgtgaagctatcttttttttgccattttggagcggtctttctactagcggaaagatcgctctttttttgcagataaaagttaaaactattttgaggaaccaaaagatcagtcgatttgtcgaatgtttcaaaaaagaagcgtttgcgggagagtcctttttttcctataataaggaaaaggggagatgacatgaaacaacaattattttttgatttagatggtacgatcattgattctagcgaaggaatctattcttcgattcgctatgcactggaaaaattaggacatgaacctctctcaaccgatggattgagagcctttgttggtccaccactgattaattcttttcgtgatctaggctttacagaagagactgcgcagcgtgctgtgaaatattatcgggagaattatcgagaaaaagggatgtttcagattacgccttacgaaaaaatcgaaaccactttggctgaactttcggaaacacatgatgtcttcattgctacgtcaaaaccagagatattcgcaaaagaaattttaagttacttagattttacagattacttcaaaggaatttacggagctgatcttgaaaataagcggggagaaaaagcggcagtccttgcatatgcactagagaaggcggatggcaatacaagtgccttaatgattggtgatcgaagccatgacattctaggagcaaaagccaatgggttatccgcgatcggtgttctttatggatttggtagtgaggaagaactactttctgcaggagcagtcgccttggcagaaaaacccctagatttgctggaattgatcagaatggatcatgctggaaaataaatgcaaaaaagagcttagaacagaggaagaaaggtgattatccccgcgatgtttgattagtagcgggacttacttcgactcttttttaagctcatgaatgttatttgatggtagtagtttttaggactaagacgttattatccagatagccactctcatttttcaaaacgagggtgccggaagtcggatgcaccattaactcgaggtgaccagttaaaaacattgtgtcgtactcagaagtatagaaagtaaacaaattgctagggatctctaatgtaaaaggaacaatgatttcttcaataggtgcgatcaagaaacgctcgccaatcatacagcagccttcagcagaggaaaactggttggaaccatcattggctgtcaagataaattgagttgtaccttgtggaagacgttgtgctgcttctgtggtaatcgttagctccatttctagtaccttctttctataaaagcaattgctatttttctttgttggctgattgacttgaacataaaaaacttataaacagataacgaaaagcattggaccagatagttagcttggggaagacgactaaaagggcacactgcttcttttgttattttaacatggaaatgctaagatgcaaagactcaggtgttatttcgttcctatcgtagtaagaagtaggctatcaatccgagaatcacgaaaaaaagaccaatatacagaataaaagttaacagggcttgaaagaattgacgcattgtcttcacctcaaatcagttgttcactatgattctagcatgaaagagcctgtttgaatgaaattctagaaatctttgtagatgtttaaggtttattcatgggaaatgaagtaaaaaaacatatattgcatgcaattggaacagaaaaaataaaaataacaaagcagttcattcatgaatctttcagctgtcacttgaatgtggtaaactaaagaggaggggataaaaatgttgcgtacatgtcaaaatgttctcgttgcgttagatggttctgagcaatcagaaaaggccttttgggaagctgtcgatatttgcaaacgaaacaaagccaaactgtatgtcctttcaatcattaacaatgcagagctttcaacgagtgcttattctttttcaaagctatttgaacaggaaaagacgagggttgaaaccgagatgctaaagaaaatctatgatgcaaataaccatggtgtcgaagacgttgcggtgatcgtagaggtaggagaccctaagcgatttatcatccatgcagcaacagaaacttatccaattgatctaatcgtgattggtgcgacgggtaaaggaactctcacaagagctgtagtgggatcgacaactgactatgtcgtcaaccatgcaaaatgttcggtatttgttgtgaaataaactattgatttgtttgatcaaaaaagggaaatcaggtaactgctgatttcccttttttatttgatgaagttttggataacgtaatctgataggtctaagttgatttatcagataggaatcacacatggtgaatacaacaaaatctagtgcagttgtactatatctagttgatatagatttgagaaaaacttttatatttttattcagacatgaggaaagtattatggacagcagtagtgtatctatcgatgattttagatttgattcttttcaatcaagcaattggatttgtttgaaaacaaaataatattttttagcttcaatgatagtgctgttttgtgattatatctataatttgtacagatttctctttattttattgctagaatttcatcccgccatgaagtaaaattttagttgcatacatactatgtgaaaaacgaaggaaacagattattttagtatcagaatggtggagaaaaatgactacaaaaatttggaagcgcttcaaaatagagttctcagtttatgtcggtattggtgtagcagtttctttagtaagtgctattaatgtgttttattttcaaaagttgctagatgcatttggtcaaagcatgcctattctaaatctagtgatttatggattgacaattatcttcgttccaatattttcttatctagaacaaaagcctaaaatgaaactccaaagtggtattttcttttatttaaaagaaatggcattagacaagattagtagaatttcctattcggaatatctaaagattggttcgggctcgcttttgcaaaaagttgaagctgggtcaagcgctggtagaaacattcatttaaacttttacggaagactttttagagagttaataccagaaactttttttaatttgttttttatagcgataatcgatttaaaattagttccagccattttaatcggctacatttttatctttattgtaaccaagtatttgttgaaaatattaaaagctataaaagaaaactcactaatctctgaagaaataatgaataatactttaatacgtggcatcacagaaatggttacttttcgaataaataaacgctataaaaaagaaatagctaactatcacgaaatgtcaatttctacaacaaacaatttaataaaaatgacaatgatacatgaatttttctttggcttttttgcttttctagttgcggtcattaaattagtcatcgttatattaacatttgcaaacgttatatctattagtttaggtggattagtcgcgttggttacttatgtcgatagagtttatacaccaattgctatcttcaatgtagtttttgtccaatatcatttggataaagttacatatcaacgattacaagatttttatgatacttcaaatgatgaaggcctcttcatcgaaggagcacctatacaatccatagcaactatcagtctgaccaatttaaatttaaccattcaaaacaaacgaatattgaaagatttcaatttagacttagagaaagataaaattttggacttgttggagaaagtggagctgggaaatcttctttgatgaaagttatattgggattattcaaacccactagtggagatatttttgtgaatcataagaatttatcttcgtataatttaaatgaatactacgatcatattttctatctctcacaagatgctcctatttttcagggaacattaaaagaaaatattgtttttgacaaaaatataccagatattcaagtaatagaggcactagagaaatgtcaattaggacatttttatcattcacttgaagaaggattagatacacgaattggtgaaaaaggttctaatatttctggtggagagaagcagcgtattgcgtttgcgagaatgttcttttctactgcagagataatagtgatagatgaggccacttcggcattggatgaatcaaccgaagaaaagttgctcaaagaagtaatgaaaatatttaagaataggatcgtccttatgattacccatcgtccgaaaaaccttgaaattgttgatgaagtaatcgtacttagtaatggttataaaatcagataagtgatttcaccgtatacggagtaaatagactaactacgactaactggagagcagcaaggtctgaatacgaaataagctgggaatgtttatgctagtttattttttctgcaataactctccattttcctgttttccgtaactatttaatttcccacttccaactaatttcccacacgtactatttaaatagtttgtagttgctttattcaaggcaggtgttcgtatattttctaattgaagtgtcgttttgttttttcgtattttttcctaatttaagggaaataattgacttttataaatgataaagagtacaattatgaaaaataaaacgaaaaagaggaaaaaatatgaaaaatgttctaaaagaaaataagcaatttgtattaataaccagtctattagttgttattggctctttaacatcaatgattactcctctattcatacaatattttaatgaaaataagatcaaactaacctatgagataatgctctttatagttatagttatgttgttttctttcttattgcagactttcatgctcgtgtatagagaaaattttgcagcaaagtttaattcgaattatttgttcaaactgataagtaagctgactaaaatttcttatgatggttttattgaaaaagaacccacgtatttaattaatcgtatatttacttcagtggattctttatatttatttttgattaatagtgtatcgactatagtaaagtcatgttttgtaattttgttatctctaggaattgttggatttatatcatggaaaatttttttgctcttattgatattacttcctttaaatttagttggctttaagcatattaacaagcaattatctattagaatggaaaaaatgcaaaaagatgctgcaagtgcaaataaagatttaattgtgacattatcaaatgtggataatataaaatcccaagctaatgtatctgcagggagcgtcaataattttgtgtaaatgattcttccctactgcagattgtttctaattctcaatcagttggcttagcatttgttcaagttcgccttcggcctgttgaaagcctttatgactgcgacctaggaatttttggttgtaagtatcaaaagacgagactaagaaacgttccatcgactcttcgttttggaactgttccttgcggtggctgtatttcttgatttgcttattaaaggattcaatcaagttcgtagaataaatactcttgcgtatggccaaggggaaatcatagaaagtgagcaagtgatcgttcgaaagaatcgattcaaccacttttggatagctggttttccttttttccgcaaaagcaccacgtgcttccaacgccacctctttagatgaggcttgatacaccattttaaaatcatcacagacttccttacgatcatcgacacgcactttgtgactgatattacgggaaacgtgtacacaacaatgttgaaaacgagctttgggatagaaccgactaatcgctcctaccatcccctttaagccatccgtgatgaacaggaggacatttttcaaaccgcgctcttgaaggtccaataaaatttcctcccaaatcgtgatggattcagtcggtgcaatcgcatagctcaatacttcctttgatccgtccgggcaaatgccaactgcgatatgaatagcttccttggcgacggttttccgctttaacggaatatacgttgcgtccatataaatagcagcataacggtcatgaagctcccgccctttaaacgccgttacctcttctgtaaatgattttgttatattggacatggtttggggcgtgtagtaatgcccatacattttctcaatcaagtctgcgatttccgacatggtaataccttttcggaagaggtgaatgacggtctcctctaacgtgtcattcgtccgtctataagcaggaacagtctgttgcttgaactcaccattgcggtcgcgcggaatctggagatgaagttccccatactcggtcttgaccgtacggtcataggagccgttacgagaattacccgtgttaaaaccaatgcgatcatacttttcgtaatctaggaaagccgttaactccgttttgagaagcgtattgactgctttctccaaatggacacggaataattcattcaaatcgcctttgttcgctagagtctttagaatttctgtagtaaaatcgttcatagggaagtcctcttttctgtgaatgtgttgtggtaactctattctacagaagggacttccttttttctatttacacaaaatattttacactctctatctgcattagaacatctgcttaaaccaaagatgattgcaatgtatgattcattagcaaataataataaatatgcacaagttactagtaatgctattgtctttattaatcaattggttcaaaatatgacttatatttgggcgagtatattaattgttcaaaatgaatttcctgtgggaaatttaattattctaagtattgttattccaatgtattattccgctttaagtgatttatctaaggcaaatgtagattataaatctttaactatttctaatgagttcattaagaataatcttgacttattacgtgaagaaaatggggaaataaaaatacaaaatataaacaatattgagtttaatttcccatcatttttaataaataaacaaatttttaattataatttaaaagaagtagtgaataaaggggatatagtttatatagaaggagattctggtagtggaaaaacttctctattgagactgatgttgaaatttagaaaatctaaaggaataaagatcaatggattagaaattaacagcttggaaaattcaagtttaaggaataaaattgcttatatttcacaagatccaacgattttgtctacgtcattagaaaacaatataggaatgggaagaaaactaaccagagatgaaaaatatttgattgaaacatctggtattttaagtccgatatttaaagaaaagcattgggatagtgtattattagaaaatggtgcgaatttatctggaggagaaaaacaaagaattgcagtatgtagattaattatatctgatgcagaattatatattttagatgaaagcattagtaatatagataaagaatctgcaaatgcaatattgaatttcattacaatcaaatcacaagagaaaattattttatatacaacccatgataaatcattcaagaaatacgcgaacaaaattattaatgtaaggagataaactatgaatcacgatttgctaagtgtatctgaagttgcggatgcattgggagtaactacaagaactattagaaactacttgtctgatggtaaattaaaagggcaaaagattggtggacaatggaaatttttgaaatccgaagtgtatcgttttataggtcagtcagttgagaaccctgttactaacttttttgaaaacgagaatcattttaaaacgggttcaatactcgtcattaatattccaatctctagtatgaggttagttgaaaatttaaaaaatgatttgttgaatcaatataacaatgtatacgatggagaaaaccgacagttcttttatcaggcaatttctaaagaacaagccagagtaataatacaaggccctatagaatacgtagctagttttggtgactggataaataataggctaagaagttattcttgagaatcattgatatttatgattgttcaaatgaacataatgaacagtgtgaaatagtgatgcaatgcatggaccgtttatcattttcgttgttgaaataaggagcaactgaaaatcatcggtgctaactgcaaacaaaaaaacaacgtcccaagaacgttgttttgagaaagccacttgacgggcttgaaccgtcgacctcatccttaccatggatgcgctctaccaactgagctaaagcggcttgttatttaacacaagatatagaatacctgaaagcctgctgtttgtcaattccattttttcaagagtactgggattttttgtcaaaaaaggtgaacaacaagacaaagaagcaaaaatttcttttttcacttgccaacttatctgaatatttgctatattacaggtagattcttccggcatagctcagttggtagtagcgcatgactgttaatcatgatgtcgtaggttcgagtcctactgccggagtcataaataaaacgtccccattgatgaaaagatgatggatgggtaaagcaaacccccctgaaattcaggggggttgctttatagatagattcaacagtttatctccttgcggctacttgttttttggataagcaaagcagtcgacatagggaagtcactttatttcagagactcgatagttgtctgctgctttacgatgcttatatgttgacctaccccacagtgatttattggaaaatgactcattcgactattgcgcaagtcaagacccagtttccttaaaaaggtgtccaaagtggataaagaagatgagagggattctatggacaacagcattacatttacaaatagaaatgaatttcgtgactggcttcaagagtatggtgtatcaagtgaaggggtttggcttttgatcggaaaagctggcggtcctaagacgataaaggctcacgaggcacttgaagaagcgctttgttttggctggatcgatggcgtcatgcaaaagattgatgataaaacatacaagaaatactttgcgaggcgcagaaagaacagcaagtggtcagaaaaaaacaaagcactagctgaaacattggaaagccaaggactaatgactgattatggtcgaagaaaaatagaagaggccaagaaaaacggtcaatgggatgcggttcagtctccaaagatttcggaggaacaaatctataccgtagcaagcttattaaagaaacatgaggcagcttatacaaatttccaagcaatgtctctctctatcaaaaagacctacacgcgggcatactatgatgcaaaaaccgacactggacgcgaaaagcgtttgtcttggatgattgaacggctagcgaagaatctgaaaccaatgtagcgatttttgggactgtgccataagtctcctacaagtaacactatccgaacattaatgattattgctcctgcggtgcagggactcctcgtcgcaaaagtcagaggaatctatcctagcaacagactattattcggtttaacttgttggatgatgacatatggcacagtcctgatagctaagaagcatgaaaaatcaagcgaagcgactcgggcaatttttactaattgcaggtgtcgcttcgcttgtttgtcttgcttgctaaatatcttcttattgcctactgaagcttttgctccagagtctcatacagtttgacggtctcagaggcgtctttgttcgtatagtagatcgtgatatcggctgtcgagagccgaagaatgggttgcgatcgtttgtccatgaatagtttcgcagattgaccagcaacgttaaagttgcctgtcaggtaatgatctgtcgccatccccattgtgcgaaccgttggctctggaagtgtatcaacaagcgtgactgttctgatttcatccaacggaatcgtttgtcggctagctaatggggcatcaaactgtacggattgatctgtcatctctccacttattgcatcaggattaaaatctaattgatacaaaggaacgatagtgacaaccatgatcgcgatcatcagaatgccggtgccgattgctaaaccttttccggtctttttgcctaagttgataccgatattcaaccccacgcggtcagggacaaataatcgaggatctgttggattaatgtacacgccataacgccaataacggtcttcatcataataccgttgttccgtagaagccaacaattgatcttgtttttttcgtaatcgcagcaatagcccaaaaggaacgaccatcaagaagaccagtaacaagacgaaaagaacagcggataactctccaactacccccgtcaactgggtcgagagcagtggaacaaaaaacaatagcagtgtgcccgtgctcattaagacgaccagaagggaccaatagaatttcgttaaatcattgaactgttgattgatttgaaaatccttcgtcaatggacgtactggtaagcggcgaatcacttgccataaatagaggaaaagcaaaaagatcaagcagttgatgaggctgaatagccaaccgggtccgttctccgcggtagggaaataaattacaccagcaatgactaataacaatgatggaagaaaactgactaatggcaacagttttctatttttttgctggatcaatttggtgtctactaaaacaggatcgatagggagtccccagttcttatgctcaattagttcgtgcatttttccaatataatgaatttgtaagacgtagcttgcccccagaagcaaaaacaagagcagccagaaaaaggtcatgaggatagagccatataaattgaacaaaaaaatcagacttgctacacttaagataccgacaaactgcataatacggcggcggtattcagcaactaacgccaaaacgtccggatgctgcaagtgatcaggagataatgtattttccaataatacgtttttgtggggcttactgagcagattcattgtaaaagcgatagaaaaaatgacgatcagatttatgccaaagaaaatgtaattcatttcaattcggtcctttcagaaaactgttctaaacattgctgaatatcggcaatgatcgctgcttcgctttttccgtgaatcaatgcagaggctacttgcagctgcagctgttgttgataatattcttcttcggagaaggtaaagctgcgaggcgctgcgacagcagttcctttgcgccgatcggtaatcagcagcccgtcttctttcagtgaattataggctttagaaatagtcatcgtgttgatgccaatctcttctgcaagttgacggacagagggaagtagttcgccgacagctaattcgcctgttgcgatcccaagaatgatttgatcgcgtaattgttgatagatgggtgtattgctttgaggtttgatttcgaattgcactggcgctctctcctttgtattatctatattaatacaaatagatggaacatgcaatcaataatcatcctctctataaggaactcacttcgcagcattaggagtaataaactgaaatttttcgttgctgttttgcaatcactttgttatcgcagtgactgaatattacggtatgcttttagttagaaaaaataaaggaggagacattatgagccactccccgaggacggcttacttcgataatgcaaaatttttattaatgattttagtggttttcagccacttattgcaaccattcattggtgatcacaagttttatcatgatctgtactattttatttttacctttcatatgccagcctttgtttttttagcaggttattttgccaaaccgctcacaaaaggttcaaaagttcgagatctggtcaaaaagtttctacttccttatgtgttttttcaacttttttatacagtttattactgggtgattggacttgacgcgtcgttgaatattcagctgctcaaccctcaatgggcattgtggttcttactcagcatgttcttttggcagctttctctcgtcttttttcagaaaatgactgccagaaaagccatcttgcttagtgtgctgctgagcatttttgctggttacctcccttttattaatcaagttctgacactgcagcggacatttgtctttctaccattttttatcatcggtttttattttcctaaaaatgagatgcagtttttacaaggaacacgaataaaaaaaatcagtctggttttcttgccgattatctatttgtttattgcgcttttccatgggatgaataagtacatggtctttggctcgaaaccttatgaagactatctgagctatccattgttcggaggaccattacgaggggtgttctttgtgattggactgctggggatcattggttttctgcgactcgtcccacggcaacagctgttttttaccaaatggggcaagaacacactgttagtctatttgctgcaagggatctttattaaaggattgagagcactggcaatcactgaactaaacttgtcactgctcggatttatggcgttgatcgtcgtcagtgttttactgacgatcctattagccagcagacctgttcggcagttctacgcccgttttgaagaagggatttcttttgtcctattgggcttgggtatcttcatgattgcgaactgaatctaaatggaaacaccgccttcgcaagtttggatctgccagacttttgctcaggcggttgttatttgatttggacaagagtaaaatgaagagaataaagtgaaaggatggagaaatatgtcagaaatttccaaaaatactactgaaaaatttgctgaagcgtatcagcaaaataacaagcaaaatgcactgcaaagaggcgtggtcaaaaacgggatcactgcttcagcagaaacgattcaaggccatgtcaacaatgtaccagtcttttcagttgatgtgacgactggcaaagtgtcaaaccaaaaacaatcaggtcgctgctggatgtttgcagcattgaacacattccgtcacaaaatgttgaatgcctttaatttgaaggactttgaattgtcacagaaccatacttttttctgggataaatatgaaaaagccaactatttttatgaaaatgtcttggcaacagcacaagagcctttatctagccgcaaggttgctttcttgctgcaaacaccccaacaagatggcggacaatgggatatgatcgtgtcgatctttcaaaaatatggtgtcgtgccaaaagcagtgatgccagaaagcagtaattcatcgaattcccgtgacttgaacaactacttgaacaaaaaattgcgcaaagatgctgggacattgcgccaattagtggcggatggacaatccgaagcagctattcaagaagcaaaagaagggatgctacaagaaatctacaatttcttagcgacttctttggggactccaccagaaacgtttgactttgaataccgtgatgaagagaaaaattatcatattgatcgcggactgacgccgcaaacattttatgacaaatatgtaggggtagatctggatgattatgtaagcatcatcaacgcccctactgctgacaaaccttataacaagtcctatacagtggaaatgttggggaacgttgttggaggtaaagaagtgaaatatttgaatgtggatatggaaacattcaaaaaattggcgattgcccaattagaacaaggagaatctgtctggtttggctgtgatgttgggcaatcttctacccgtgattctggaatcatggcattggatgcgtatgatatgaacgacttattcgatatcgatttcacgatgacgaaagctcaacgtttagattatggtgaaagtctgatgacccatgcgatggtcttgactggtgtggacatcgttgatggcaaatcaacaaaatggaaagtcgaaaacagctggggagaaaaagtcggtaccaatggattttttgtaatgagtgatgaatggatggatgagtacacctatcaaatcgttgttcgcaaggaatttttgacggccgaacaactcgctgcttttgaagcagagccgcaagtcttagctccttgggaccctatgggagctttagcataatgaagaaatgaaaagctgtgggcgtatgttaagagacgatcgaacaaattttacgaggactgagatagaaacggttcattttctatcaggtagaccaatttgtttgatggaccgtttattagctgcgctgtcacagctttttttgtccatttttatgatctttagcagaaaaatgtgaaacttattaattgtaagatcgccattctttctataaaataaaacagtcactaatgatgccacacgtctcattagagtgaactgttgaagaatggtcactgggaacctttacttccactgacagactttgtcattttacttaatgttaaaggaggagactaatgacaaatctgtttatagttattgttgtacttatttttgctgcccttatttatgggttctacctgatgcaaaagcgtcatctgaaattctctacacgagtgtttacagcgttgtttgtcgggatactttttggtggtatcttacaggcgatctttggaactggctcggaagtgatcacccaatcactagagtggatcacaatggtggggaacggctatgtagcactgctgcaaatgttgatcatgccattggtttttgtttcgatcgtcggggcatttaccaagatgaaagaaagcgaaaaaatcaaaaaaatcagctttactgtgttggctactttgttgggcacgacagcaatcgctgcactgatcggaatcgtgatggttatgttgtttggtttagacggtgcgagttttactgaaggcgcagcggagaccgcacggatcgctgagttggcagaacgttctacccaagtccaagacttgtcaattcctcaacagatcgtatcctttattccgaataatgtttttgccgatctagctgggacacgttcaacgagtacgattggagtggtaattttttctgcttttgtagggattgcctacttaggggtgaagaaaaaagccccgaaagaggcgcaaacgtttgctgatctaatggatagcttgtacaagatcgtgatgcgaatcgtcacacttgtgttgcggttgactccttatggtgtattggcgttgatgacaaatgttctagcatcaagtgatttcgaagcgatcctaaatcttgggaaatttattttagcttcttatgcagcattgatcattgtcttgctcgttcattccttgttgttagcgagtgtaaaagtcaatccaattacttatttcaagaaagcttttccagtgttaagttttgcatttacttcacgctcaagtgccggtgcgttgccattgaatatcgaaacgcaaacaaaagcgctaggtgtcgacgaagcaaccgccaattttgctggtagctttggcttgtcaattggacaaaatggctgtgctggtgtgtatccggcgatgttagccacgatcgtagcgcctacggtaggaatcaatgtctttgattggcagtttatcctgcttttggtggcggtcgtaaccatcagttcttttggtgttgctggtgtcggtggtggggcaacctttgcttcattgatcgttttaggatcaatgaacttgccgatcgcaatcgttggtctagtcatttctgttgaaccactgatcgatatggctcgaacactggttaatgtcagtgacagcatggttgccggtgtggtgactagcagtcgtatccatgaactagatcgtgcaacacttgaaagtcaaactgctgtgattgatgccgattgattcaagtagaagccgctactaaaatcaagtgataacaaaagagtgtttattaagaaagactgcgtgtggtctttctttttttgtgaccaaaaatcagagtcactattgttattatgtgtcattatggcttactctgaccgctatctttagtagatgagagaataataaagaaatattcaccgctttttttatgggtttctgctatactttttgtatacaggcgcaggagggatcaagatgacacaactgattcagttagaaaatgcagcaaatgtcagagaattaggcggttataaaacgacatcagggaagaccattaagcggaaaaaactgattcgtagtgccgcgatcaatgagctgtctgagacagatcaagcaacattgagcaactatggcatcaatcaaatcattgattttcgttcctatgaagaagccaaagcacagccagatcagccaatccgttatgcccagcagttctttttgccgatttttagcgaagatgaaacgatggtttccttatcaccagagacattgaagcaaaagctggcagatggggatgatgcagaagatcagatgaagaaggtatatcgccactttgtcgaaagtccgcatgctcgaaagcaataccgtcatttttttgacttggtattagaaaatgcggaagcaggagcaaccctatttcattgtacagcagggaaagatcgaacaggcttcggggcatttctgctcttatctttattagaggtggatcaatcaactatcaaacaagactatctggcaacgaatcgctatctggggccttttttaaaagagaaatttgcccctatggcgcagcaaatgccgcctgaagttcttgaagccatcaccacattgatgagtgcaaaagaaagttttcttgatgaaagtttagcagcgatcaaaaaagaatttggcacggtggatcagtatttaaaagaaggactggcaatcacaaaagacgaaaaagagtattttcacgcccactttaccgagtaaaggatgtgtccaacatgaatcaggaattgcttgcccagtttgggttatccggaacattaacgccgatcagcgggggtgacgtgaatcagacgttccggttgcggtcagaagaaagacagtatttcttgaagtatcatccaggagtatcccagcagttttttcaagcagaagcagcaggattggcacaattacgtccctatgttcgcgtacccgccgtttatcaatatggagataacgaacatggcgcctaccttttgctagaatggatcgatgttggtgaaggtgatcaagagtcgatcgccactgctttagctgagatccatcggcaaacaagcccaacgtttggatttgaacaggacaactttattggcttattgccgcaggtgaatcccgcggcagaggattgggtgagtttttataccacgtgccgcttagacgttcaggtggaattggccaagttaggaaatcattggaatcctcgccgagaagataagtacctaaatctgaaagaaacgctgtatcaagagtggtcaggtcgacaggttcaaccttctttactgcatggtgacttttggcgcggcaatgtgctgtttgatcagaagggtgatccagttttcattgatccggctgtatcctttggtgatcgcgaacttgatctggcgatggcgcaattattcggcggatttcgtccggaatttttccaacgctatcagcaagtcttcccgctggaaaaaaattggcaagagcgggttcctgtgtatcagttgtactatttattggttcatttgaatctattcggtgaaagttacggcaataatgtagatgagattttgagtagatattaggaggcatttggcaagatggtagcaaagtatcaaaaagaacatgaagtcgcttattatgagtgcgatatcaatcagacaatgacgtttccagcaatgttgggagtggcaatcaaagtatccgaagagcaaagtgcagtattggagcgtgggccagaatacattcgctcttttggactgacatggatcattactacttaccatatcacggtcaatcggttgccgatggtcggggaacagatcatggtctcaacacaagcaaaagaatacaataaatatttttgctaccgctatttctggctgcacgacgcccaaggaaatgaattagtgaagatcgagtcggtttttgcattgatggatttggcaacacgcaaagtcagcagtgttccagatgagatcgtcgctccttttgaaagtgagaaaatcaagcgcatcaagcgctatcctaaaatcaattccccagaaaaaggacattttttaccttatcgggttcggttttatgatatcgacagcaatcagcacgtcaacaatgcaatgtattttaattggctgctggatgttttaggctatgaatttttgacgacgcatcaagtgaaggaaataacgattcgttttgaccgagaagttgagtacgggaacttggtagaaagtcattttgaaacgattcgggatgagaaccatttggaaacattacatgagatcagaatcggagagacgacgtactgcgaagccgcaatgaagtggcatgaacgaacaaaaaataatgaaaacaactaaccgcactgacaatcgtctgttcttagcgattgaccttctcttaaaaaaggtcagttgctaagaacaagcgaaggtgcggttttttgtcagtttagtttctaaaaaagtcaacaatcagttttccataaagtcgtgtaattcaactaatggcagccgacgatttttggcgatcagcaatttgattcgggctttttgactgttgatgctattgcaaaagatgactcccatctcctgcagttcttttccgcctccagaataaccatagacaggttcggcaataccgttgaaacagcgggagactagtacgactgggatttgtttcgccagtaatttttttagcggcggtaatgtttggggtggtagattgccagctccgagggcttcaatgaccaatccatcgatattggattctgctaaggcctcaaaaagttctccatgcatgccggcataggctttaacgatcggaatcaagccatcgacccgatcaacatccaattggcgactctctaatagttcctgcatgaataatattcgattttttgtgaccagcccaatgggacctagtgttggcgtgcgaaaagttgcaacattcgttgtatgcgtctttgtgacataacgagcagagtggatttcgtcattcataacgactagaacaccctttttttgagcatcatcacattttgctacgcgaatggcactttcaaaattatataaaccgtcactgccgacttcattactggagcgcatggcacctgtaatgacgataggcagctgattgccgatcgttgtatctagaaaaaaggcagtttcttctaatgtatctgttccgtgagtgacaactacgccatcgattccacttaaatgagccaactggatgcgttctttgatttgcagcatttgctcaggtgcaatgtgaggactaggtagattaaagatatcttcaacgatcagttcaacatcgtcatcgatatggataggggcgtccatcaatgggtttgtgacgtctggactgacaccaccggtcaacacatcttctttcatggcaatggtgccacctgtatgcaaaacgaggatttttttcatttttgtcacctcaaagattattttactcataactccaaaactattgtatactaatcaaataagaaaacaagcaaggtgaggaaaaatgattcgaattggttgtacgacatttagtgaacatggttctcttgttcagagaaaaacatcaaaactttttgaatatgccagtgtctttcctgtggttgaactggatacgtcttatcattatttacccaaagagaaggatgtgcggaattggttgacgcaggtaccggataacttccgttttattcttaaagtgcatcaaagcgtaacgacacaaggtgatttgccggaaggtatgtctatggcagaagcactaacagctttcaagcaggcgattcaacctatggtggatgctggccggctttattgtttgctggcacaatttcccaaccggtttaagtgtacgaaagaaagtgtggcgtatttagatgaagtacgtcagtggtttgcagcgtatccggtggcaatcgagttgcgggataatagttggtatcagccagagttccgctcttcgatgcaagcctatatgcgcaagcaaaagttctcgttggttattgttgatgagcccaagaaactctccactacggttcctttagaaccgctagtgactaacccggcatttgccgtatgtcgttttcatggcagaaatgatgttggttggacagctaccggacctgacgccaaaaagaatcggacgctctatcgctacaatgagaaagaattaagtgaactacgtcaagcagtcgaagaaacagcggctcacgcacaagaagttgctgttatttttaacaataatgctggcggtgatgcggcggacaatgcccgcgcgttgatcgaagccatgcaaatcgattaccaacaactgaatcctagccaattggagctattttgaggagttatatgattaaagcaattttttttgacatcgatggtacattgatcgcagataacgggaaagcgatggcaagtacccgagcagcgatcaaagaagccagaaaacaaggtgttttatgtggcgtggcgacaggccgcggacctgtagaattagagaaagtcatcgattatttagatttggatatgttcatcacctataatgggcagtttgtctacaccaaacaaaatttgatttatgccaaacctttctcgaagaacatccttgaagaaattgttgcatatgcagatgaaaattatcggcaggtaatgtttggcggagaaaccaaagtggctggcagcttgacgattcgtttgagtcaatcaccagtgatgcaacgttatttgcgattcgtcccaaagaagtttcccgttggggtgctaaaaaaattgctgcagcgattcagtccaaatcgaaatgccaaacggtatcagtctctggatattttgcgggaaccaatttatcagtgcattatgctgagtcccgaatcagagaaagaaaagctaaagcaaaaactgccttcctgtgatttcaaacgctccaatgcctattcagtggatatcgtccccaagaaaggctcgaaaatgaagggaatccatgagtttttggcttatgaagggatcgcgatcgaggaagccatggcttttggggatcacgaaaatgatatcgagatgttgaaaggtgttggtattggggtggctatggggaatgcgcagcaagtggcaaagacagcggccaattatgtaacagcatctaataatgaagatggtatcgctcaggctctgaaacactatggcatcatcgaataacacataactagaggaataaatggaatacacgaattgattgagtgagatcaacggaggaggaaagaagatgagtccttttgaaatgacagaagaatttcatcaaacctttgacccgacacgtccggagcaaccacggccattcacaccagaaaaggccagtttccgtgcagggttcaaagtagaagaattagttgagtttttgtatgcagcggccaacaatgatcccgagcagttcgcacagtcagtggcggatctgcatcagggaatcgagcaagcaaaagaaaagatcactagcaaacaaaaaccagtgacggatacgttagtcgagcaagtcgatgccttatgcgatcttttgtatttcacctatggctctttttcactattgggtgtcgatccggcaccaattttgaaaatcgttcatgaagccaatatggggaaactttttccagatggcatgccccattaccatcctgtgactcataaagtcatgaaacctgcggattgggaagaacgttttgctccagagccccgcatcaaagctgaaattgaacgtcagatcgtagcaaaaatgaagagttgacttgaaacgagtgaacacccataaaaataagatgacctttgcaaaatcattcgcaagggtcatcttgtttttttgttctaagtgtatttgaggggcggctttgttgggaaaggccactgactatcaatcaaaaaaggtataatacaaagttcgaacagcggctttctcttgttctttatggataccaaacataatactgacctcggaagaaccttggttgatcatttccaagttgatgttcttgcgggccaatgcagctgtgctgtctgcagtgatccccactcgttggcgcatcccttcgccgacgactacgaccatggataagtcgtgggtcattcgtaattcatctggatcgatctcataagcgatcttgcgcagcaattcttcttccaacaccggatttaattgattggctctcataatgatcgagatatcatcgattccggacggcatatgctcatagtttaaatcaaattctttgaaaatctcaaggacgcgtaaagtaaaaccaacttctcggttcatcaagtatttacggatgtagatcatacagaagccttcatcactagcaacaccgacaactggttgtgtcaagttgttccgttggttggtaatcatggttcctggatgtgtgggattattcgtatttttgataacgacgggaatctttgcccgataagaaggcatcaacgcttcatcgtgcagcaccgtgaatccggcatacgaaagttcccgcatttctcgataagtcagttctttgatgggttctgggtgatggacataacctggatgagccgaaaaaataccatcgacgtctgtaaagttctcataaagcgtcgcgttgacaccagcagctaccaatgcaccagaaatatctgatccgcctcgagagaaagtacagatttctccatcctccgtatacccaaaaaatcctgggatcactaaaatttcttctgtttctgcccaggcattgatttttgtgtaagatgctggcaagatccgggcgttttggggttcatcagtgactaagatccctagctcctctgggtttaagtaacgtgctgctagaccggatgcttgtaaaattccggcaatcaaacgagcgttattgtcttctccactagctaagatcttgtcatgaaaatgtgggtcatcattaggcgacaatgtcagaaactgctgtaaagcactttggatctctgccaataattcaggcgccacttgaaaaggggcagcgatggcagcataacgcgcataaatttctgttaataagggacggacatcttttgatgcagctagtccttcacaagtggctaataaaagatcagtcactttggtatcgtctgcatggcgtttaccgggggcagaaacaacaacaaaacggcgttgtggatctgcttggataatatcaactactttttgcacttgctcggctgaagcgagcgaactaccaccaaattttgctactttcatcttgcattactcctgttcaagcttttttctagagtacagtgtcaaaagtgagaaatcaaggcatttcttaaaaaaggcaccaaaaaacaggaaaaagcttttttgatttcggcttttccaaggaaatttagagagagcttgttaaaaaaagaatgaaaaattggaggaagtcgcaaaaaagtcaatcttttttgccgcaatttaatgcttgatttttttctttatgctataatctagcgtagatgctttttttgaaaagggacaagtgggtccttttatttgagataccttacatacccaaaaacggatctgtgaaaacgcggatttcatacgaaaagtgtagatttgaaaattggaggaaccataaaatgggaactaatatcatctttggaatcgttattgccattgtcgtcatcgcggcgatcttatatgcgatcggttactttatgcgaaagaaaaatcaggagaaactggatgtcttagagaaacgtaaagaaaacctgtttgatctgccggtcattgaagaagtcgatgaagtgaaaaaaatgcatttggtgggtcaaagccaaaacacattccgagaatggaaccagcaatggacagatatttccacctcctcatttgcggaactggaaagccaaatctttgaagtcgaagagttgaatgaacggattcgctttttcaaagctaaaacagcgatcgaacaagcggaagcaaccatggatgatatggaacgtcaagtcgaagagattcgtgccggcttgaaagaacttcgtgaaagtgaagaacgcaattccctagaagtccaaaaagcattggatgtttatgaagatttgaagaaaaacttgcgggagcatggagaggaatttggtccagcttataacgaactgcaaaagcaaatcaaaaatatcgagattgaattcactcaatttgttacgctgaatacttccggtgatccggtcgaagctcgggaagttttagaacaagcagagcaacacacctatgaagtcgaagatttgatgaaacgaatcccagctgcttatgaagagctgaatcgtacgttccctgatcaattaaaagaaatccaagatggatacaaaaaattattggatcaaaaatacgtctttcctgaagctaacttccaagaagatatcaaccgcgtgaaaaaacgggttgaaaattctatgaatgatttagccaaaacagaagttgcttctgtggaggtagctaatcgggatacagctagtgacatcgatgctttgtatacggtaatggaacgtgaaatcaatgcgaagaaatatgttcttaaaaatcgtcaagtgattgttgactacatcgatcatgcgacgaaaaacaatcgtcaattattgattgagttggatcataccgctcaaagctatacattgaatcataatgaattaggtcgggttcgtggcttccaaacagaagtcgatgaattggctcgccgcaacaatgaatacttgccgcagttggaaaaccatgagatcccttattcagaagtacaaagtttttataaagatgcttacaaaattttagatgatgtcgaagcgcaacaagttgaaatcgatgaagcgctaagtgatctacgccgtggtgaaaaggtcgcacaagagaaagtagagaacttcgaatttcgtttacgtaacctcaaacgttttgttgagaaacagcgtttgccaggcttaccaggggaatacttagaattcttctttgtcgcaactgaccgagtggaagaattaggcaaagaattgaataaaattcggatcaacatgcaagaaatcaataaattggtttcagtttgtgaagaagatttagacatgcttgatgaacaaacgaaagatttagtggatgcagctgcattgacagaacaaatgatgcaatatgcaaaccgttaccgtcattcacatgccgacatcaaagcagcgattgataagagtttgtatctgtttacgaaagagtatcgttatcaagatgcattagatgagatcgggacagctttggaacgcgtcgaaccaggtgctttcaagcggatcgagaacttctatttcaagaatcgtgatttagtataaagcaaaagccagcagtgaaaaactgtctggcttttttagtgaattggcggattctctaccgacaaatcgatccaagaagaggaacttcttgaaagagcaggaaagagcagttataatgggaaagaatttttcaaagaaagggtcctagcattgatttattttgataacagcgccacaaccgcaatttatccgcaagcattagatacatatgtaaaagttagtcagcgtattatcggcaacccttcaagtcttcacgatctgggcagtcaagccagccgtcttttggaacagtctcgggcgcaaattgctgagctgctgcaagtttctgcttcagagatttggtttaccagtggggggacggaaggagacaattgggtcttaaaaggcaccgcgatcgccaaaaaagcttatggcaatcacttgattatttctggcatcgaacatccagcggtcagtgagaccgcagaacagttgaaagaactagggtttgacgtgagtatcgcacccgttacttctactggatttgtagatgtcgctgctttgcagcaactgatccgaaaggaaacgattcttgtttctgtgatggcagtcaacaacgaaattggttcgatccagccaatcaatcaaatcgctgaaattctagaagctcatcctcgcatccacttccatgtggatgctgttcaagcaattgcgaaggttgatcagcagcaatggttgccacaacgggtagactttgccacattttctgcccacaagtttcatggacctaggggcgtcggttttatttattggaaaaaaggccgtaagctaacaccattgatgaccggtggcgggcaagaacaaaatcagcgcagcgggactgagaatttaccggcaattgttgcaatggctaaagcgttgcgactagcacttgaacaaaaagctgcccggcctaaccatgtgggcttattgaaaagttacctttcagaagcattatctgagtatgagaaagtgacggtgttttctggagccgaacattttgcgccgcatattctttgtttctcattggaagggatcagaggagaagtgcttgtccatgcctttgaagaaaaacagatttatctctcaacgactagtgcctgctcttcccgcaagaaaatggctagcagcacattgcatgcgatgcatgtccctagtcgcttagctacttcagcagttcgggtcagcttggatgaaagtaatacgatggccgaagtagaacaatttttgattgtatttaatcagctttatcaaaagttctcaaaattaagccaataagagcatgttgcgaacataccaacgacaaacaaaggagttttactcgtgaattatacagagatcatggttcgctacggcgaattatcaaccaaaggaaaaaaccgccgcagtttcattatgcagttggcggagaatgtgaagcgaacacttgccgactttcctaaagtcaaagttcatgcagaacgtgatcggatgcatttgcttctgaatggggaagacagtcaggcaattatattgaaattgcaaaaagtgtttgggattcaaaatttttctcccagcattcgggtagaaaaagacgtcgaagtgttaaaagaagccgtacaaacagtgatgagtgaaatctatacagggactgagaccttcaaaatcactgccaaacgcagtgaccatcaattcatccaagacagtaatcagttgaatttgacgttaggaaatgctgtaattgatcgctttccagaaatcaaagttcaaatgaaaaagccagatatcaatctacgggtagagatccgtatggatggagcctacctttcttacgagacgatccaaggagctggtgggttaccggttggaacgagtgggaaagggatgctgatgctttcaggcgggatcgattcccccgttgctggttattttgcgatgaaacgcggggtagagatcgaagcggtccattttgccagcccgccttatactagcgaacaggcactacaaaaagccaaagatctgacaaagaaactaaccccttatgttggcggtattcagtttattgaagtcccattcactgaagttcaagaagaaatcaagaagcatgtgcctcaaggctattggatgacgatcactcgccggatgatgctgcgactcacagatgcgatccgtgaagctcgtcatggattgattattttgaacggagaatcactaggccaagtggcttcacaaacattgcaaagtatggtggcgatcaatgaagtaacgaatacgccaatcattcgtccggtggcaacgatggataaattagaaatcattgatgtagctcaagagatcgatacgtttgaactggcgatccagccatttgaagactgctgcacgatttttgctccgccacagcctaagacaagaccgaagttggagaaagtgcatttatatgaagagcgcttagatatagcaggcatgatggagcgggcattagctgggttgaaaatcgaagagatccaagcttccgaaaaagcagaattcgctgattttctttgatcttcacatcagaaaaaattttgatatcaggggataaaaaccagctgttgactgttggcaattaaagaaaaaagatggttacaaagggtgtgcccaagtagccgtcttttttcgtttatgctggacctgtgagagatttctcacagtcgtttgactggaatctaggaagcattaaaagtttgtgaaaattgcttgctattcaatgacgagcatgctaaactcgatatgtgaactatttaacaaggaggacggaaaccatggaagcattaagagaaaaaaaacttcctaaagcaacagcgaaacgtctgcctgcttatttaaggcatttaaaatttttggatgcatcaggtgtccatcgaatcaaatcaaaagagtttgctgagatcacacaagttccttccgcaacgattcgtcgggacttttcccacttaggggaattaggacgaagcgggtatggttatgaagttccttacttgattgaagtttttagccatatattagaaacgaacgaagcaaagaacattgcattagtgggctttggcaatctaggtaaagctcttgcaaacaacaactttcgccgcaatgagaatctttcgatcgttgctgtatttgataatgatccccaattgatcggtaagaccatcgacggtcactatgtttatggaatggatcagctagctgagatcgttcaggagaaaggaatcactgtagctatctcgacagtacctagtcaatattctcaggcggcaatcgatacgatcgtagaatctggcattacagcgattttaaattttgcccctgatcgcgtcaatgtacctaaaaatgttcatatccaatacatcgatctgacgacagaattacagacgttgatcttttttgacaatacctattctcagaaatcgtaggttttgagcaaaatcttttggctttcgcgggttctctcctatactggagaaaactgtaataggagagatgacatgcaagtaacacgtaaaggaatcatttttgaagtaccaggcattcagccaaaagtaggggatcaagccaaagaatttgaactgaaaagtttagatgacaaagtttatcgcttggctgatttcttaggtaaaccgacgatcttaagcattgttcccgacattgacacgcgggtctgtgcattgcagacgaagcgcttcaatgaagaagcaagtaagattgatgaggttaattttgtgacaatctcgaacaatacgaaagaagaacaagcaaattggtgtggacaagaagggatcgatatgctgatgctgcatgatccagaaaatacgtttggagaaacctatcaaattatgatcccagagtttggacattttgcccgcgcgatttttgtcttagatgaaaaaggggtgatccgctacgaagagatcgtgcctgaaatctctcaagaaccggactatcaatcggctttggccgctgccagatcaatcgctgtttgactttcaaaaaagttcattgtagaatgaacaagatcaattgaaagaagacgaggatcaagaggagtatcagacggactgtttttacagagagaagaccaattggtgcaaggttttcagcaggaatctgagaaggtagcttgtgagtctttgattggaacagcaaggaacaccttgttcagtagaatcaaacgcttcgtgaccgttaactcacgcccaagaggtagagaaatctacaatttaggtggtaccgcgtatttgcgtcctaaaatgcttcggcattttaggactttttttattcccaaaagccgagcggtcttgaaggaactgatcaaaaaaagtaggaggtaaaacaatgtccgataacttatcaacaaagtacaacccgcaagaagtcgaagcgggacgctaccaggaatggttagccaaagatctattcaaaccaagtggtgatcaaaaagccaagccttattcaatcgttattcctccgccaaatgttactggtaaactacacttaggccatgcgtgggatacaacccttcaagatatcatcattcgccaaaaacggatgcaagggtttgatacattgtggttaccaggtatggatcacgctggaattgcgacacaagcaaaagtcgaagaaaaactaagagaacaagggatctcccgctatgaccttggtcgggaaaaatttgtcgaccaagtgtgggaatggaaagaagaatatgcaggccatattcgtgagcagtgggcaaagctaggattgtctcttgactatagtcgagaacgattcacattagacgagggtctgtcagatgctgtccgtaaagtcttcgtaactctttacgaaaaagacttgatctatcgcggcgaatatatcatcaactgggatccgcaagcacgtacggccttatctgatattgaagtcatccataaagagatcgaaggagctttttaccacatgacttatgaactggcagatggttctggtaccgtagagattgccaccactcgtccagaaacgatgctaggagacactgcgatcgctgtccatccagaggatgaacgctaccaagaattgatcggcaaaaaggttattttgccattagttaataaagagatcccaatcattgcggatacttacgtggatcaagaatttggaaccggcgtagtaaaaatcacccctgcccatgatccgaatgactttgaagtcggtaaccgccataacttgccacgggtcaatgttatgaacgatgacggaaccatgaatgatttagccggtaaatatgctggcatggatcgttttgcagctcgtaaagcgatcgtcaaagatttggaagatatcggacgtttgttaaagattgaaaaaatgattcacagtgttggccattcagaacgaaccggtgtcgttgttgaacctcgtttatctacgcaatggtttgtcaaaatggggccattggctaaagaagcgatcgacaaccaatcgacggatcaggcagtcgagtttttcccaccgcgcttcaatcaaactttcttgcgctggatggaaaatattcacgactgggttatttcccgacaattgtggtggggacatcaaattcctgcttggtaccacaatgaaactggtgaaatgtatgtgggcttagaagcaccggcagatgccgaaaactggacacaggatcctgatgtactggatacttggttcagctccgcattatggccattttcaaccatgggctggccagatgaaaatagtgctgattatcagcgttatttcccaaccaacacgctagtcacaggctacgacatcattgctttctgggtaagccgcatgattttccaaagcttggaattcacaggcaaacgtccttttgaaaatgtgctgatccatggactgattcgtgatgaacagggacgtaaaatgagtaagtcattagggaacgggatcgatccgatggaagtcatcgaaaaatatggcgccgatgcattgcgctggttcttatcaaatggctctgcaccaggacaagatgttcgcttcagctatgaaaaaatggatgctgcttggaacttcatcaacaagatttggaatgcgtcccgttttgtcttgatgaatgttgaaggaatgacggtgacagatattgatttttctggcgagaaatccgtagcggaccgttggatcttaactcgtttaaatgaaacgatcgagaaagtgactgagttgtttgatcgttttgaattcggtgaagcaggtcgccagttatacaactttatttgggatgacttttgtgactggtatatcgaaatgagcaaagaaaccttatatggtgaaaatgaagcagctaaacaagtcaataagagcattttggttcatgtgttggatcaaatattacgcttgctgcacccaatcatgccgtttgtcacagaagaaatttggagtaaactgcctcatacaggcgattcgcttgtagtagctgcttatccagaagttcagccagagtggtcggatgagaaagcagcacaaggaatggaagtgttaaaagagttgattcgttctgtccgcaacattcgggcggaagtcaacacgccgctttctaagccaattacattgctgatccaaaccaacgatgttgagatcgagagcttcctgatcaccaacaaaaactatatcgaacgattctgcaatccagaagagctagtgatttccaatacactggaagcaccggaattggcgatgtcagctatcttatccggagcaacgatctatttgccattagccggcttgatcaatatcgaagaagaaatcagccgtttagaaaaagaattggcgaaattcaatcaagaggtcaaacgcgtgcaagggaaattagcaaacgaacgtttcgttgccaatgcccctgaagaagttgtggcgcaagagcgagcgaaagaagccgattatttggataaacaaaaagcagttcaagaacggatcgagcaattgcgtacgattcaataatctatttattgaatcgaggcagcaagctaatcatcgatattcctatggaacactagctgttgcaaattaccgatctaactatttactctctaactacccgatctctagctacccgatctatagaggaaagaattcctaaccgctatagatcgggtagttttcctatcgatttttgttgggaacgctctgagagaaagagcagtagaattaggaaaaaaagggaagatttgctaaaatgattttgaggtgaagaacatgacaagtgaagaagcaattgcatggatccacggaagaaagaccttcgggatgcgtccaggattgatgcgagtagaagcattgctacaacgattaggcaatccagaaaaaaatctgacattgatccatgttgccggaacgaacggcaagggttcgactgtcagctatttacgaagtcttctagaagaaagtgggctgcaagttggaacgttcacatcgccccatatcgagtctttcaatgaacggatcgagattgatgggcgttttataccagatgactcgctgattgaatgggtcgaaacacttcaaccactcgtcatgcaactggatcaggaagaagaattgaccggaatcacccaatttgagattttgactgcactggcattcggctactttgcccagcaacaagtcgatgtggctatcatagaagttggcttaggcggccgtttggatagtacaaatgtgatcacaccaatcttgacggccatcacgactattggaatggaccatatggatatgcttggtgacacgattgaggccattgctgcccataaagccgggatcatcaaacccaaggtgccactagtgactgggaagatccctgaaagtgcgctatccgtaatcgaccttgaagctgcagaatctgaggctcctgtatcccacttgggagaagactatcgagtcacgtatcatcgtccggatgaaatctggggagagtggttcgattttgagaatgaccgcggaaaaatcaaaggactgaaaacgccgatgattggtcgacaccaaccagaaaacgccggtgtcgctattcaattatattatttattctgtgagttaaaaaaactgccattttcggaaaaagtagtccgcaatggcttaaagaaagcttattggcccgcgcgaatggagaaaatcagcaatgaaccgctgatcattatagatggtgcgcataacacgcacgccatggaacgcttggttgagacagttagagaagaattcaccaactatcgcatccatatcttgttttcagcattggagacaaaaaatgtcgatgagatgctgcaacagctgttaacgatcccgaaagctgaaatctatttgaccacatttgattttccaaaagcgatccatttaagtgatgattaccagcaattgaatgaagcgcgcatctcgatcgtttcactatggcagtttggcttagcagaattattagaaaaaatgaccaatgaagacttgcttctgatcactggttcgctttattttgtatcagaagttcgggaacttttgttgggaatgggaggaagaaatggctgaattaaatggtgtgatttttgatatggacggactgatttttgatacggagcttctttactatcaggcaacacagatcgtggccgatcagatggagatcccctatacaaaagatgtctatctagcatacgttggtgtttcagatgaagaagtctgggcggcttatcatgaacgatatgatgctgccttcggtccagagactgttgatcgtttcatccaagccgcttttgatcaaactctgctgctctttgagcaaggtcaagcagcattaaaaccgggggtccatgacttgctgcgctatttggatgaaaaagggattccgcggatccttgcttctagcaaccaacgacgagtcatcgatacattgctggattccgcaggtctgacgcaagaatttccagaaatcgtttgtttcgatgatgttgtgcgggcgaaaccggatcctgaaattttcgaaaaagcccataatcgcttaggggttccgaaaaatcaattagtcattcttgaagattccgctaacggtattcatgctgcgcatgcagctggcattccggtgatcatggtacctgatctggttgctccgacgtcagtgatcgaagaaaaagtgctgcatatcttgccttcactggtagaagtgccggattattttgagcaggcctatacttggtagtgtcgcatcaaccatgaactcttttgcgtagttttattttagactaacgcaaaggagttttttttatgaaagacaatggaattcctcaaagttcctatcctcgagaacgactattgcattatggcgctgaagctttatccaatcaagaattgttagcgattcttttacgaacgggttctcatcctttcaatgtcatcgaactagctggtcagatcctcaacgagtttgaagacttgtatgagctaaagcacgtgacattggacgaactgcaggccattcgtggggtaggccagatcaaagcgatcgaactcaaagctaccgtagaacttggcgcccgcatccaacgagcagcacagccaaaatatggcagagttcattccagtgtggatattgccaatcagatgatggaggaattaaaagattaccagcaagaacatttgctgtgtctctacctaaataccaaaaatgagatcatccaaaaaaagacgttattcatcggcagtctcaatcagtcgattgctcatcctagagaaatttatcacggagcagttcgttgctgtgccgcccgagtgatctgcgtgcacaatcatcccagcggcagtccccaaccttcgcaggcggatattacctttaccaaacgattgatgaagtgtggggaattgatgggtatcgacttgctggaccacttgattatcggcaataattcatatatcagcttgcgagaagaaggactctgggaaggctgatcgtctaccttgcaaaaaaatagtagcaagtgtaaaatattagtgtaattttgtttgctgaatagatgttgaaacgcttgttacacctctatcggacacgagcaatgttacacataattaagtgcttatgcacgaggaggttttttataatggaacaaggtacagttaaatggttcaatgctgaaaaaggatttggcttcatttcacgtgaagacggtacagacgtatttgtacatttctcagcaatccaaggtgaaggcttcaagactttagaagaaggccaagcagtgacttttgatgttgaagaatcagatcgtggacctcaagcagtaaacgtaaacaaagcgtaagcttatttacaagactgcattcatgggattagtgaaggcacagtcaaaaaagaccatcattcagatggtctttttttttgctcgcgttctttgacaaaatcaatgaacgtgaggatttctttgattccttcttctgagattgattcatcgacatgggaactgatcaagtcactttctactttaggatagaggtgtctcttatcagatcggcctaagagatagtcggtcgacacaccaaatagatcggctaacacttgcagcatgctaaagtcgggctctctttttcctgattcataggcagtataagctggacgtgtgatcccgattttgtctgccacttcttgctgagttaacttcttttccagacgtaatttttttatgatttgcggaaacataatgacacctgcctctctcgtgatagtaacacaccgttacttagaaaaaaagagtcggttggtgtctatttgttactaaatgtcgttgacaagtgtcataaggaaacatataatgagtgtgtgtcgaaacgttacattccgaagaaggagggaactgtatgcgggagtggctcattaggcaacgtgaaaaaaatggactcactcaggatcaagtagctaaggaatccgaaattgagcgaacatattacaatatgattgaacgaggaaaacgccgaccaagtgtagaagtagcgaagcggatcggtaaagtgctccaatttgattggacgtatttttttagcatcgaaggtaacataacgacacaaaaagacaaacctagttaaatggaggaggggactcaagatgcctgtaaaaggtacagttgcaaaaatcggctatctgggtaaaaacaaaagaaatttccaggatctaaaaaaaggtttaaagaaacacaagtggctctacgtcatgctgatcattccagttatttttgtcgtgatctggaattattggccaatgtatggcgtgattatcgcattcaaagattattctcccgcatttgggatcttaggtagcccttgggtgggattgaagcactttgagcgtttttttgcttcctatttttttctcgagatcattgttaataccttgcgcttgagtctttacagtttgttggtcagtgtaccattaccgatcattttggcgttattattcaatgaattgaatcggaaatggttcaaatcaaccgctcagacgatttcatacatcccaaattttatttcggtggttgtcgtgatcgggatggttcaattctttttttcaagtcaagatggcatgattaatatgttgctgaatacatttgggtttccatcgatcgattttctcggaagtcctaaatggtttccgcatatctatgtgtggtcgggtgtctggcaaggtgtggggtggggaacgttgatttatacggcagcgatgtccgggatctctcccgatcaatatgaagccgcttacttggatggtgcctctcgcttgcaatgtattcgtcatatcacgattccttccatcatgccgaccatcgtgatctccacgatattggcgacaggaagcattttatccgtgggctttgagaagacttttctcttacagaacgctgcgaatctcgcttcctctgaggtgctttcgacatatacctataaaatggggatcataaatggggagtatagtttctctgctgcagtcggtctttttaataacgtgattaattttattgttttatttattgttaataaactagcacaaaagacaaatgaatcgagtctttggtaggaggaaaacgaatgaaagtatcagcaacgaaaggggataaactgtttaatactatcaatatcttactggtcagtctgattgccctgattatcttatatccgcttatctttgtggtcaatgcttccttcagtgatcccactaggatctatgaggtcccgttgcttttgtatccccgtggattaaatgttgaagggtacaaggaagtgctcaagagcagtgatatctggacgggttttcgcaacgcagtgatctacacgggtttagggacagtgatcaacttaatcgtcacgacgattgctgcctacccattgtctcgttccggcttacgaggcaagcgtttctttactttattttttacgattacgatgttttttagcggagggttgatccccacttatttagtcaatcagcagttagggatcgttaacacactttgggtcatgatcttgcctggagcgttgggtgtttataatatgattttgatgcgtacgtatttcagtcaaaatattcctaatgatttgattgaaagcgcttatatcgatggtgccaacgatttatggttattatggaaagtcgtcttgcctctggctaccccgatcatcgcagtgatggcaatgttctatggtgtcggtcgctggaatgcctactttgacgcgttgatttatttacaggatcgtgccaagtatcctctgcagattattctgcgagaaatactggttcagggacagtttggccaagatatgaaccaaatcattgccggtagtgcggaatccgaactgcttatgctgaaaatgaccctcaaatacagcgtagtgatcgtttcaagtctgcctgtgctcctattttatcctgtggtagccaaatactttgaaaaaggcatcctagtaggatccatcaagggatgaggaggtgtttcgatgctaaaagcgatcgctgcattttgtgaattagtgtacgatatgatgcttttgaatgtgtattggtggcgctacatgcttctgggcggtgtgctgtttagtctgataccggcaacgattactgtctacgattgcattcgaaaaaggattctgcagaaaaatgaagctcctctcaaagaaattttttcagatcaatatcggcacaacaaacaaaaaaatcgctggtttcatgttgcggctattgttctgactggttttgttattggggttcatcacacattagcgagtgattatcccaccagtttcttgtttgagtttacgatgcggacgaatctcctgattattttattgctggcgatcacatttttccctgtgcatgcttatttttcattagacaaagtccatcgttggttacagccgttactgtttgtgttcatttgtcccgttcagctattaataagtatgggacttcttggattggttagtcttctttattgttactatccatttttagggatctgtttagggatcggattgcctgcttatgggataggtttcttgtttttcaataaatttaacaaaatgaaaggagtctatttttgatgtcgcccgttgttcgattgtataaaaaggagagaactgtatgaaaaaaggagtgctattgtttttgttgtccttcgtctggctgttgtcggcttgccaatctagtccaagtgaaaaagtagcagatgacgtaaagtcgattcatttaatgaggaatgattttacagacgtgaggccgaaaagcgaagacctgtggatgtggcaagagtacgagaagaagtctggagtcaaagtacagtgggaagaagtaaaagagtttggggaaaagaagaatttgattctatcaggaaagctgcctgatgccttttatcagaccggctggagcaatgatgagatcgtgaaatacggacagcaaggattgttcattccattagaagatctgattgccgaacatgcaccgaatctgcaaaaaatcttagatgaaaatccgattgtcaaaaagacgttaacagcaccggatggtcatatgtactcgctgccgtatatgtctttggatccaatgagcggcgggcgaacggttcgactgtatatcaatcaaaattggctggatgaattgtccttggatgtccctcgtacaacagatgaactgaaagaggttctagctgcttttgtagcgagcggggaaggacgagaagggtattatatgccaagtggctggttagccggcggactggaaaaggtcttgatggcttcctatggattggggacaggcggcagacaggcgatggggaatatgctgtttgtggatgaagcggggcaattacagttgaccatcaaccatgaacggatgcgggaagtctggatgtacctaagagagttgtatgcagaaggattagttgcaaaacaatcctttgccggcgtggatgatgacaaatggcgagcggatgctgcccaagacaaagttggtctcttccagtgggtcgatcctgatttcattggcccatttggaccagaaacgtatacgccgatcaatgtcattgaaggaccttatggcgacaagacactttatacggaaccgcctgtttctggtacttcagcatttatcattacgaaggatgcagcagatccaggattacttcttgagtgggtggattacttctatagtcctgaagggcagatttttgcttatttaggagaagaaggagtgacctatgaagttgacgaagatgggcacatggtctatattgacgaaatcttaaactatcaaaacgggccgcaactcggtgctttccagtgggtcgataatgtgtatggaggctatttcccttatgcggaattggatcaagaaatcagagatcgagcgtttggcaaagaaccggctgtctatgatgatgtcaaagaagaatatatgccggaatacatgctgccgacatttatggcaaccgaagcagaagcagcagaattgtcaacgatcgttacagatatctcaacccatgtggaacaatcgcgggtaaagttcattacaggtgaatggaattttgaaaaggattggaccaactatgtgcagcaattggatcgtatcggtgctcaacgcttattggagatccgtcggcaacaatttgaacgctttaatcaagactaacttaagggcgaataagcagtaggaaaaccaagtgaatgccaaaggagcagaacaaaatggattattttatgcaagaagcaaaaatcaagcaccgcattcaagaaatcgaggcattgaggtatcgaaacaagcgtcagatccagcaatggtttgtcacagaggatcagacaaagtgtcagaaatatccgccactcttttcgactgaacaagtcatgcacataggggaaacgtggcaaggaagggatcgctatttatggcttcaagcgaaagtcaccattcccccgaagatgaatatattgttttttgattttggaaaaactggtggcggcaataactctggttttgaatcacttttatttattgatggtgtccctgttcagggaatcgacgccaaccacaaagaatttctattagaacctgcaaatttaggaaaagaagtgatcgttgcgctgaagctatggtctggactagaaggcggtggcgaagaacggcagctgacccatgaactgaaagctgcatttatcggttatttggatgaagaagccaacaattatttttatctttctaaaatgattttagaaacgatccagcaattagcagaggatcatgaccggaaggttcggctgctcaagatgttgaatggttcgtttcaacggatcgattggcgagaaaaaggatcaccgcagttttatgatagtttgcgggaagcacatctttttctaaaagaggcgctgcaagcacttcccaaaagtgacttggttcaagtcacagcgattggacacacccacattgatcttgcgtggctttggcagttgaagcacacgcgtgaaaaggcggcccgcagcttttctacagtcttgaaattgatgaaagaatacccagaatatgtgttccttcaaacccagccgcaaatttaccaatatatcaaagaggactatcctgaattgtatgtgcaaatcaaacaacgaatcgcagaaggccgctgggaagttgatggcgccatgtgggtcgaagcagattgtaatctgcctagtggcgaatcccttattcgccagattctctacggaaaaaagtttattcgcgaggaattcgggcgggaaagcacctatctctggctgccggatgtttttgggtattcatgggcgttgccgcagattctgaaaaaaagtggaatcaatacctttatgacgacgaaaataagttggaatcaatacaatcgcatgccaaacgacacctttctatggaaggggatcgatggctctgaaattttgacgcatttcatcacgacacccgttccaggtggtggcagctggacagaaaaatccaattggttttacacgtataatgggttgctgaccccggagacggttttaggagtatatcgcagctatcaaaataaagcattgaatcaacatctattgatttcctatggacatggagatggcggcggtggtgtcacccgagaaatgttggaaaaccgcagaaagatggctgaaattccgggattaccgatgcttaaaacgggtcgggctgctgacttttttgaagagttacatgaaactgtcgaccaaaattcgaacgatctaccaatctgggatggggaactgtatttggagtaccatcgcggtacctatacttcgcaggcctttatcaagaaaatgaatcgctggtttgaaatacgcttgcgggaacttgaatgtttgtacagtcttcagtctatgacagcaggaacggcttatcctgctgcagtattcgaaaagctttggaaaagcgtcttgaagaatcaatttcatgacattatcccgggctcttccatcaaagaagtctatcaagattatcggaacgaagcacttgcttgtcaaaagcagcttcatgctctgacaactgctcttgagacagaagaacaacaattacgtatcatcaatacagccgcttggcagcgaacaagcatcattgcagtagcaccgggcacggtacctgaacagcagcaagttttcttcgacggttcctgttacgctctggtacatttgccagcattccaagcgagtcttttgccggattgtatctgtgcgttgccattggaagcagtgtccgttagtgaaaaagaccgactcgagactccgttttatcaagtccgatggaatgaggcggggcatttgacccagatctatgacaaaaccgcacaacgagaagtgcttgctgggacagggaatgtctttcaattatttgaagacaaaccattgaatttcgatgcgtgggatatcgatcttttttatcaagaaaaaggcacggagctaagcagtgcaggcattcaagtcatcgcgaacaatcctttgtttactgtcttagaacagcaagtcacttttgggcagtcaactattttacaaaaaatctatttctatgctcatacgaagcgaattgattttgttaccacggtggattggcaagaacgccagcaattgttgaaagtgaaatttgatgtcaatattcgcgcgacagaagctatttttgatattcagcatgggaatgtgaagcgtccaactcactggaacacgagctgggatatcgccaaatttgagacagtaggtcatcagtgggcggatgttgcacaaatggattacggggtggcccttttgaacgactgcaaatacggctacgatatcaaaggcaatcagctgcgattatctttattaaaaggagcaacatacccggatcctcaggcagatcttggttcccacacgcttacctacagcctatttccgcatcaaggagattttgcaactggtcaggtgatggaagaagcttgggagatcaatgcaccattgagtcaacttcaaacagagatggcaagtattcctcttgaaatcgaggctgatgaaagtttgataatcgacgcattgaagttagcggaagatcaaagcgggtggattttgcgttgctatgaccatttagggagcgatcgcgacgtcaccattcactgtcatggaactggcaaaattcgctggcaagagacgaacatgatggaagaagctagcgaagagttaaaagcggagccgatcgcattttcattgcatccatatgaagttaaaaccattaaactggtgcttagcgaaaagtagatagttctcctgaagagatgtatcggtgagatcacttcttagatcgtttttaagacagtttttaatatagcctccaatatagctaagtttccaaagtagttttaaatagctgtggcaagagacagtaccgataatcctgcgtctaatttcgaaagaagagagtcttaaacctaaggaagtcagtaggatgaaaaataaaaaactcgaccacttccattgagggtttggtcgagtttttttgttagtggtcgtcaggtgtcatgatcatcgaaagaatcattgggtgacgttctgttttttcaaataagaagggttgcaaagcagctgacatggcttctcgcattttatgttcgctaggatctggctggttcaagacttctctgagggcacggaacaggatctgttgtgcttcattgatcatctcgccagattcccgcatatagacgaatccgcgggaaagaatgtctggtcctgctaagacttcttttttcgtcaagtcgacggtggctacggctagcactaagccttcttctgataagatacgacggtctcgtaagacaacgttaccgatgtcgccaattccactaccatcaacatagacatcacccgcattgaaatgacctgctcgacgagcagaatctgcagttaacgccagcatatcaccgttttccataataaaacagttctcttttggaacgccgacatcttgtgccagttgggtatggatattcaacattctgaactctccatggaccggcataaagaacttaggcttcatcaaacgaagcatcaatttttgttcttcttgaccaccatgtcccgaggtatggatattattcaatttcccgtggatcacatgtgcacctgcttctaacagcaagttgatcaagtggttgacactagtcgtatttccagggatcggtgaactagagaaaatgaccgtatcgtctggatggatctgaatttgtcgatgagtaccattggcgatccgactaagggctgccattggttccccttgagagccagtacataggatcatggtttcattagctggtaagcgattgatctcatgagattcgacaaatgtaccgtcagggactttgatataacctaagcgctgcccattaacgatcgcattttccatacttcgaccgaagacagcgatcttacgacctgtggcaaccgcagcatctgctgcttgttgcaaacggaaaatattggaagcgaagctggcaaagatgatccggccttcgattttttcgaaaatcttgcggatcgaactaccaatcgttttttctgacttggtaaaggtcggaatctcagcattggtactgtcagaaaggaggcatagcacaccttcttctccgattctggccattttgtgtaggtttgctggttcgcccacgggtgtgaaatcgaacttaaagtcaccagttgctacgatatttcccgaaggtgttttcaccacaacgcctagcgcatcaggaatactgtgggtcgttcggaaaaagctgaccgatgttttgcggaagcgaatcacggtatcttcattgatctcatgtaatgtagcatctcgcagtaacccgtgttcatccaacttgttggtaatcaaagccaatgctaatggaccagcatagattgggatatttgcttcacgcagaaggtaaggaataccaccaatatgatcttcatgaccatgagtgatgactaaccctttgactttcgtgatgttttggacaatgtagctataatcggaaatcacatagtcgattccaagtagttcatcttccgggaatttgatcccggcatcaatcaagatgatctcgtcttggaattgaaccccataacagttttttccgatctcgcctagtccgccgacgccgaatacgccagtttcattattttttagagaaactttcattattaaaactccgctaatttgaaatcagcgttctctttttcatacgcaagatgtttttcatcaagttcttgaataaactcgatgttatatggggtgttttgttcgactgtacggcgtgcagcaaccgcgctttctgcgtcaatgtacagggaatgggtttgttctctttttgggttgcggtcttttgtttcttgatagtaaactttgtaaatcatacaaattctcctttatctgctaatgcagtagtttatcgttttgttcgattcggtgcatcacaaaatcaaggccctagataagtgacctgaaaagtgggggtcgtcagtggaccgctacatgctttttccagacaatcgttgtgagaaaaaagagaaagcctcgtctttgctttccaaatgttgtcataaaaaattcaccgttttttgtaaatcgttccattacaagtagtattagtttatcatagaaaagtaaataagtatagaaactagttggtttgaaagggcttcccttggtcatccttaaaaaaatactttaaaatatctcctttttttcttcgggaagtgggttacttgaaattgggactatgatatagtaaaaataatgtgtaaaaaaaggaggggcttttttgaaattaatgtggcattacacaatgcgcaataaaaaactgttggtttttaatttcatctgtgtgtttggatttattttgattgaactaggattacccacattgctggctcgaatgatcgatgtcggtattcgaaatggtgaccgagagtatatctggaagatgggaatggcaatgattgctattactttgacagggatcgcaatgaatattatgttagggtactttacctcaagaatcacaacgaatatcgtagcagatgttcgagatgatctttttgaaaaggtgcaaggttattcacatacggaatatgaaaaaatcggtgtttcatccttgattactcgggtgaccaatgatgcatatcaaatcatgttgttcttgcagaatattctgcggattggattgatgacgccgatgatgtttgcggtcagtttgtatatggtcatgcggacaagtacaaaattagggatgtatgtgttaggggcactgccgatcttgttgattgctgtgatagccatcgcaaagatttccgagccgttgtctaacaagcagcaagccaatttggataagatcaatggtattttgcgggaaaacttgtctggtttacgggtcatccgtgcgttcgtaaatgagaaatttgaagagaaacgctttagcaaagtcaatcaagcgtatgcatccagctctcgcagcttgttccgtttgatggcgacagcacagccgggctttttcttcttattcaatatcgtgatggtactgatcatttggtcaggaagtattcaaatcgaaaatgggcaactgcaagtcggtgacttgattgcttttatcgaatacatcttccatgctctattctcattcatgttgtttgcgactatctttacgatgtatccacgtgcagcggtctcagcccgacggattcaggaggcattggatatgacttcagaaatcgtggaagccgaacagccagtgacagaaggcaagaccaaaggatatgtggaatttaagaatgtgacatttgcctatccgggacatgctgagagtcctgtgatccgcaatgttagttttactgcttctcctggtgaaacagttgctttcatcggcagtactggaagcgggaaatcaacattgatccaattgatccctcgtttttatgatgtcacaaaaggacaggttttgattgatgggatcgatgttcgcgagtacagcttgtccgctttgagaaataagatcggatttattccccaaaaagcgttgctgttcactggaacgatcgcagaaaatctgcgctatgggaaagaagatgcgacacaagcggacttagaacgtgcggttgagatcgcacaagcagctgattttattgctaaaacaccggatggctttgatgcacgtctagcagaaggaggcacgaacttttctggtggtcagaaacaacggctggcgatcgctcgtgcggtgatccgtcgtcccgagatctatatttttgatgatagtttttctgcactggattatcaaaccgatgccaaattacgggcgcgtttgaaaaaagaaacgaccgaatcaactattttgatcgtggcgcaacgtgtggggacgatcatgcacgcggataaaatcattgtgttgaatgaaggcgatgtagttggtatcggcacccacaaagaactgttggaaaactgctcggtttattacgacattgcagcatcacaattatcagaggaggagttggcacaatgaaagcattctcttctttaaaacgtttagggcgctacatcaaaccctacaaagtctcctttattttagtcttactttttactgtcgctacagttggctttaacgcggcattgccgtatgtgtccggattgcctacaacagagatcagtcggaatattgcagcgggagagccgctgaattttgattacatcatcgtttgtttgatctggatcaccgttgtcggtgtagggtattgtttctcacaattaatgtcagggcttttgatcacaaatgtcgttcaatctgcgatgcgtgatttacgtcaagacattgaagaaaagatcaaccgcttgcctgtttcatattttgacaaaaatcagcaaggaaatatcttgtcacgggtaacgaacgatgtggatgcagtcagtggtgcgatgcagcaagccttgatcgggatcgtcaatgcctttctaggaatcatcatggcggtagcgatgatgttttatatcaattcgtttatggcgttgatcgcattgatcatgattccaacgtcattgatcatttcaagaacgatcgtcaagaaatcgcaaaaagacttccaaggcatgcaaaatgcattaggagacttgaacggttatgttcaggaaaatatgactggtttcagtgtattgaaagtctatggacgagaaaaacaaacacttgacggctttaaaaaagtcaatcaccaactgcgctattacggcttccgttcggccttcgtctcgggattgatgatgccgttagttcaaatgactgcctactttacgtatattgctatggcagttatgggaagtttctatgtaattggcggtgtgatcgtggtagggcaactgcaagcctttatccaatacatttggcaagtgagtcagccaatggggaatattacccagctttcctctgtcttacaaagtgcttcggcagctgcaaaacgggtttttgagattttggatgaaccggaagaaccagtcaaccaaacagatattccattgccagcggaatttcatggggatgttcaatttgaacatgtcggttttgcctatgatccgaagaaaccgctgatcaaagatttgaactttgaagtgaaagctggtcagacggtagcgatcgtcggaccaactggagccggaaagaccacattgatcaatttgttgatgcgtttctacgatgtcaacgaaggggcgatcaagattgatggtattgatacgaagaaaatggcccgcagcgatgtccgttcgttattcggcatggttctgcaagatgcttggttgtatgaaggaacgatcggagacaatattcgttttggtaagttagatgcgaccgattatgaagtggtcgatgcagctaaaacagccaatgtggatcatttcatccggacgatgccggacggttatgagatgtttatcaattccgaaggggataatatctcgcttggtcaaaaacaactcttgacgattgctcgagcagtcatttctaatccgaaaatcttgatcttagatgaagcaacaagctctgtggacacacggctcgaagcgttgatccaaaaagcgatggacaaagtgatggaaggacgaaccagtttcgtcattgctcaccggttgtctacgattcgggaagccgatttgatcttagtcatggatcaaggagcaatcatagaaaaaggcaatcatgaaacactactggcagctgggggattttacagtcagctttatcagagtcagttttcagaagaagcagaataggtcaaaagagtgtggtgtcagccgcactcttttttttgtatgaagtgtgaagatatccgcatatagtcgctgttctcttacggactgattcgtggttttcatagttattcatggtatcatgggtacaggaatagagtagtatagtagtaaagtatagtagtaaagtgtagtagtaaagtgtagtggagaaagaaaaatcctaaaggagtttaacaatggatcggaaaaaagagacaaatagccaaaaacgaaatcaactaaacgcagaaactgctagtacgcaaaactttatcgcgccaaatgcgactgtcgtcggagatgtcaccatcggcagtgaggcgactgtctggttccaagcagttttgcggggagatgcaaattatattcgagtaggtgagcggaccaatattcaagatgggacgatcattcatgtggatcatgatgcacccacgatcattgcagaagatgtgactgtcggtcatcagtgcatgcttcatggctgtaagattgaaaaaggggccttaatcggcatgagttccattgttttgaaccatgcagttatcggtgaaaacagtttgattggtgccggttctttagttactcaaggaacgatcattccgcccaatgtgctggcttttggacgtcctgctaaagtgattcgtccgttgacagaggaagaaattgccaaaaacaaagccaatatcgcccattatgtttccttgggaaaagactacttgcaagggaaatatgtttattaatggcaagcgaagtcaatcggatctcgtttaatgacgcaaaaaaaccagcgtgcttcagcacagctggttttttgatggatgaattattttaagctgtttgattccatgatctcgtcgatcaagccgtaatcttttgcttcttgagcagtcatgaagttatcacggtctgtgtctttttcgatgacttcgattggttgacctgttcgctcagacaagattttgtttaggcgttcgcgagtttgcaaaatgtgacgagctgcgatttcgatctctgttgcttgtccttgtgcgccacctaatggttggtggatcatgatctcagcatttggcaaagcaaagcgtttgcctttttcaccagctgtcaataagaatgaacccattgaggcagccatccccataacgatcgtttgcacgtctgctttgatgaagttcatggtatcaaagattgctagtccggctgtgacgcttccgcctggtgagttgatgtacaagtagatatctttttcagaatcttgtgcatccaagaataaaagttgggcgatgatcgaattggctaaatcatctgttacttgaccacttaacataatgatgcggtcttttaatagacgagaatagatatcataggctctttcgccacgagatgattgttcaatgactgtaggaattaaattcattttttagtcctcctaaaaatcgatatagatatagtttagcacaaagtttttgcaatatctaaaagtaagtatacccattaggtcaataaaggtcaaataaaaagttcgttatcttttttgcctctcttttaaattatgatacaataaaaagaaagtaagcatgaaagggtcagaagaaaatggcagtagcgattgcaggttttatcggcgtattagtaggcgccttattagtaacgatcatcttcaatctcagaattcgttacgatgaacaaaaagaaaaacggcgacggctgttggagcataaagtcaaagaaatcgagacacttctccaattgaacaggaaaatcagcgaaattttacaaaaacgggtgatcctgatggacgaatatgtcagtttcgatgctttcgatgactgttatataacgatcgatgattttgcttatttacagtcttttgccgcacagaataacttttatttgccgaattattttttagaagaatttttcaagaaaatcggtacccgcagagtgatcctttcaccagaagaaacggtgaagatcggcggttatacgtataaaggcggtcgtgtcatcatggagaatttcttggatacactgactgaaatggtcaatgagcgcaaaacgcaaatgaaaaatttgaccaatgaaccattaacttatttttctaaaccattatagtcgagtcaatcgagaatggggctataacattgagtctgtgacagaagttgcaacgagatgatccgaaggacgtgaacggaattgcgctctccatcgtgtatttgatgaagacctgctgcagagtaggagcaatttcatgattgttgggaggatcattttgtggaaaaacttctgtcatagcctctttttttgtcgattctctgatatatacaaatcctagcgatgcctttagaaaatgaggatggcacaaggagtaggagtttggttctatggggttccgtggtaaaatagaaaaagattggagtgaaacaaatggtacaaatcgttgcccatcgtggcagtagtggagaccgtccagagaacacgttaccagcctttgcagaagcagttcgggtcaaagccgatatcattgaactagatgttcatctatcaaaggatggtcacctgatcgtaatgcatgatgaaacagtcgatcgcactacgaacggcaaaggccgaatttgtgataaaacgctgacagaactaaaagaattgaataccggcagctggttctcagaagattatgccgccacaaaagtgccgacgttgaaggaagtcctcgatcttttagcagcaaagaattatcgtggtattttaacgattgaattgaaaacagaccattacgagtatcaagggatcgaaaagaaagtatctgaattgttagccagtcaaagctggccctttactcattggtattgttcattcaatgttgacacattggatcgattgtatgcgattgaaccgcaagcaacctttgactttattatgggaaaatcggaggcgaaacctccgttagcattgtcgcgcccttacattgaagggattcatcctgcctatgagtgggtcaagaaacatgaggaacagatcgcggattatccgattgccattcgtccttggacagtcgatacagaagcagaaattcgtcactgtcttgcagtaggggtcacgggaattattaccaattttcctgagcgagtccgggaagtccaaaggaaggttcaggaggaagctcattgatggaaaaagtgattgtggtagtcggaccgactgcggttggaaaaacggccttaagcatcgaactggcgaaaaagtatcagggagaagtgatcagcggcgactccatgcagatctatcgtggcttagatattgggacagccaaggtaacagctgcagaaatgcaaggaatccctcatcatctgatcgatattcgcgacagccatgaatcctattctgtggcagaatttcaaaaagaagcccgtgagttgatcacggccacccatcaacgaggtcatctgcctatcgtagcagggggaaccggattgtacatccaggctttactctatgactatcaattaggagccgctgaggaaagtgatccttccgttcggcagcgctaccagcaagaagcagcaagaattggcaaagaagcgctatggcaaaagttgcaggtattagatcctttagccgcagcaaagatccattacaacaatgaacgtaaagtgatccgcgcgttggaagtcttggaaacaacgggaataagcattgcagccccgactactgcaccggaagcggtatacgattattttatgattgggctttccacagaccgacagttgttgtatcagcgtattgatcagcgagtcgatcaaatggtggaagcaggtttggttgcggaagcacaacaggtgctgatccatcctgagacccaagcagcaaaaggaatcgggtacaaagaatttgccccttattttgccggtacatgttcattagaagaaacggtcgcacaaatcaaacaacagtctcgcaggtacgccaaacggcaactgacttggttcaagaatcgtctcgctcctagatgggtcgatcttgtccagcatcctgaggacgtatcttcgatcgaaaaagcgatcgaccaatggttggaggagaaggaatgacacaagaacgcgtaatccttgttggcgtagaaacagaacgaaattattcgacctttgcgtcctcaatgaatgaattgaaaagtttgaccaaaacagcaaacggagaggtgattttttcactgatccaaaaacggccgcaagttgatcggcaaacagtgatcggaaaaggaaaattggcggaactgcaacagttagtggatgcccatgaagctgatttggtgattttcaatcatgaattgacaccccgacaaagccagttgattggtgaagaattaggggcgccagttattgatcgtgtccaattgattttagatatctttgctatgcgcgctcgttcaaaagaaggaaaactgcaagtagagctggcacaattagattatttgctgcctcgattgatcggacaagggaaaaatatgtcccgtctggggggcggtattggaacgagaggaccaggagaaaccaaactggagacggatcgacgccatatccgtaatcggatcacgatcattaaacgagagttgaaggaagtcgctgctcatcgtgatcgtacccgtcagaaacgccgcgacagtcaagtctttcagatcggtttgatcgggtataccaatgctgggaaatcaacgattttgaatttattgactagtgcggatacctatgagcaagaccaactgtttgcgacgttagatcctttgacaaagcgttggcggttgccggaaggattggaagtgaccgttaccgatactgtcggctttattcaagaactgccgacacaattgatcgatgcctttcattctacattagaagagagtcaaaatatggatctgctgctgcatgtggttgatgctggttctcatgatcggcaacagcaagaaaaaacagttttagcattgatggaagaactatcattgacgcaagtcccagttctgacgatctataataaagctgatcgcattgatccagaacaatttgtgccgacgctgttccccaatgttttgatttctgccaagagcagtaaagggaaagaacaactgatccaagcaattaaaatggaactcatgcaaatcatgcagccttatcaaaccgttttagctgccaatgaaggcaagcgattgagccgtttgaagcgggaaacactcttgcttaccaatgactttgacgaggaagatcaaacctatcacctaaaaggttttgcattgccaggttctgccgggatctatccaacaattgaagagtaacgctcaggaaatgaagtggtcgagctgtgtgtagggaattctaatacctgcacgcagttttttttcagtgattaccactggaaatttttttcattcgaccagtaaaaggatggttttctagtgattgttctgccaaacagaaaaaaataaatgtctatgtcactttttcttacatgaagggttgacagtggaaaaaacaattggtatagtttcaattaagttatgcaggatcatctaaatgagggaggcgccacgttatgcgggaaaaagagttgcggcgttcgatgtctgtctttccgattggaacagtgatgaaactaacggatctgacggctcgtcaaattcgttactatgaagaacaagaactgatccatccagaacgcagtgatggtaatcgacgcatgtattcattaaatgatatcgatacgctattagaaatcaaagactatctgtcagatggtttgaatatggctgggatcaaacgtgtgtacgagatgaaaattgccaaagaacaagaagcaaagaacaaaccgccactgactgacgaagatgttcgtcgaatcttttatgacgaactcctagcgcaaggtggtctgaatcaacaacagccattccaacaaaaaggtccgctaatgtagatcaatgttgtggcacgaaagaataaaggtcaaaggaagggatattatgccgaaaattgaaagaacagccgaagatatcaaacaaatcgttaaagacgagaatgtacgtttcttgcgcttgatgtttactgacatcttgggaacgatcaaaaatgtagaagtaccagttagccaattggaaaaagtacttgagaacaaaatgatgttcgatggctcctccattgaaggattcgtacggattgaagaaagtgatatgtacctttacccagatttatctacttggatgattttcccatgggaaagtgagcatggcaaagtcgctcgtttgatttgtgatatctacaaccctgatggcacgccatttgctggcgatcctcgcggcaatttaaaacgggcactatcagatatggaatctctaggttttacttctttcaatcttgggcctgaaccggaatttttccttttcaaattagatgaagatggcgaaatcacaacagacctaaatgacaaaggcggctattttgattttgcaccgactgacttaggtgagaactgccgccgcgatatcgtattagaattagaaagccttggttttgaagtagaagcctcccaccacgaagtagcaccaggccagcacgaaatcgactttaaatatgccgatgcggtagaagcgtgcgataacatccaaactttcaaattagttgtcaaaacgattgcccgcaaacacggtttgcatgcgacatttatgccaaaaccattatatggcatcaatgggtcaggtatgcactgcaatatgtccttgttcaatggaaaagaaaatgtcttctttgatgaagaaggaccaatgcagttgagccaaacggcgtatcatttcctagccggtttgattgaacatgcccgtgcttatacagcagtctgcaacccaacagtcaattcttacaaacgtctggtcccaggttacgaagcaccggtttatgttgcttggtcaggacgcaaccgttcaccactgattcgtgttcctgaatctcgcggcttgtccacccggttagaattgcgctccgttgatccatccgctaatccgtatttggcaatggctgtcttgctgcaagccggtttagatggtatccgtcgtgagttgacaccgccgcctgcagtggaccgcaacatttatgtgatgaatgaagaagaacgtgcagaagcacaaatcgaagacctgccatcaacgatccacaatgcgatcaaagaattgcgtaaagatgacgtgatgatcgatgcattgggcaaacacatttttgcgaactttgtggaagccaaacgtttggaatgggccgcttttcgtcaaacagtttctgagtgggaacgcgagcagtaccttgaattgtactaatcaattactagtcgttcgatctgcagaggcaacaaacgaataagtcattggaagatggtccttagaatctattgaagcgtctgtgacaaccgatacaaaaaaagaaaccgctagagaaaaccaatctagcggttttgttctgtaatctattcaaagtagaagacaggaatcgaacctgcaccttgttttcgcaaaaatgataagaaaacgatttctgatcatttgtaacaaaacaagtaaagcaccgagcttcctctacaagaatcattatgacaagcagacccaaagaatccattaagaaagtaagaaagaagtttagcgatttgtgaatgttcatcgaaatcagcgatttttcgatgtatccgcatccagaaaggattcgagaaaagtttgcttgacttttgctaggcaagattgtatcattctgtttgggcactcttgaaaaagagtcagaaagtgatttagaattttcgctccctattcatttatggatagggagcttttcttattttctaagtacttttcctgcaaaatagtttaaaaggagtttttcagtttatgacaaaatatatttttgtaaccggcggtgtggtttcttcgatcggtaaaggtattgtggcagcatcactaggacgcttattgaagaatcgtggcttaaaagtaacgatccaaaagtttgatccttacatcaatgttgatccaggaacgatgagcccataccaacatggtgaggtattcgtgaccgatgatggtgcagaaacagatttggacttaggccattatgaacgtttcatcgacatcaacttgaacaaatactcaaatgtaacgactggaaaaatctattcagaagttttgcgcaaagaacgtaaaggggaatacttaggagcaactgtccaagtaattccgcacatcaccaatgaaatcaaagaaaaaatcatgcgggcagcaaaaatgaccgattcagatgtcatcatcactgaagtcggcggaaccgttggcgacatcgagtcgttgccgtttctagaagcgttgcgccaaatgaaagctgacgttggttcggacaatgtgatgtacattcatacaacgttgattccttacttaaaggcagcgggtgaaatgaaaaccaaaccaacgcaacacagtgtaaaagagttgcgaggattgggtatccaaccaaatatcctagtggttcggactgaacaacctgtgtcccaatcaacaaaaaacaaattggcccaattttgtgatgttgcacctgaagcggttatcgaatcccgagatgtagaaacactctattcgatcccattggctttacaagcacaaggaatggatcaaatcgtttgtgatcacttgaaattgaatgcgccagtagctgatatgacagaatggcaagcattagaggaaaaagtattgaacttgaaaaagaaagtccgcattgcattggtagggaaatatgtggaattgccagatgcgtatctgtctgttgttgaagcattgaaacattctggttttgcttatgatgccgacattacgatcgattggatcaaagcccatgaattaacgaaagacaatgttgccgaatacttacaggatgcagacggtatcttagttcccggcggttttggcgatcgtggaatcgaaggcaagatcgaagcgattcggtatgctcgtgaaaatgatgtcccattcctagggatttgtctgggaatgcaaatggcctgcgtggaatttgcccgcaatgtcgttgggttagaaaatgcgaattcggcagaaactgatcccgatacagcaaacaacatcattgatttgatggcagatcaagaaaatattgaaaacttaggcggtacgctacgtttaggcttgtatccatgtaaagtcaaaaaaggaacgaaaacagctgcagcctatgaaggagaagaagtcgtacaagaacgtcatcgtcaccgttatgaattcaataataaataccgcgaaatctttgaagcagaaggtatggtcttctcaggtgtctcaccagacaatcgcttagttgaaatcgttgagattccagaaaataaattctttgtgggttgccaattccatcccgaattgatttcacgaccaacacgtccacaacgattgatcaaagcatttgttggtgcatcattagacaatcgtgggtaacacatatagtaccagattaaaaaccagctgttgagctggtttcaggttgtaggcaatgtcccggaaaagggaggcctacagcctttttttaagcataagagtacgctctaaataaatgtgggggaaatatagtcaggatcactcgacccatttataaaggaacgttctcataaaacacccttcaaaagttagttttttgggttaacttttgaagggtgtttccgttctagccagtgctagtgctttttttagtagcatccgaagtgatacgccttttcagctactcctaactattaaagataaaacttcttgtagaaattgaccctaataaaagggaccatatacctatggaggttgactacaatagactctaaactaattaatgagggagagaaagatggaaaaaataagcttattgttgatcagggctctttcagagcaagacgggtttatgacaaccaaagagatcgctgcaaaagtaggtgtcagtacgaaaacagttcgtagatatgtggagaaaatcaatcaaagccaatcgctttatggctgtgtgattcaagggaagaaaggaagtggcttgtttttacaaataatcaatcatgaattatttcaacgtagcttagaaaacacacctcaagaagattttgtgacacaaatcattgagtacttcgtccaagaagacgaatacatcaagtcagaattattatgtgaacgcttatttatctcacaaagcaagttatctcaagaactcaaaaaactgcgacggattttaagccattataatttatccatccaaacaaagccttactacggcatgaagctttgcggcagtgaattcgacttacgtcgctttatggcaagcaattatctgcaaaagacacaccttaaacaactgcatcaattaccttctagtgaagggacgccatcgcagttgcatcgacagattcaagcaatcattttagctgagttttctcaaaaagcctatccgatttcagaagctatagtgacgaacttagtcaatcacctagcaatcgctgtaatgcgaatgcaaagcggccgctacttggatcgcaatctgcctattggaggaagaaccaatgctgaacaatcattattaggcaagcgaatcgtcaagcggatcgaagaagaatgcggtgttctttttacagaatgtgagcgaaattatgtgcttcgtcagatcgtggggaaacgggtcattcccaaaaatgaaaaaaacgttgtctcagaggaagtttcggacttagtgaggcaagttctaaaaaaaatcaaaaaccgaagacaaattgacttcagtcaagatttggacttacagacgatgctgatgcttcactttgttcctttgattgatcgaatcgaattaggaattgagctgaaaaacccgctgttagatgacgtaaaagtccattgcaatgtaggatacgacttagctattattgctggtcaagtaatcgttgcgcatttcaataagcgtatcagcgatcatgaacttagctatttagccatgcactttgatgtcgccctgaataagaagagttcacaaacgcagcgtaagtatattttagttgtaaacgatctggggagagcagccaatgcatttttaaaagaaaagtttgaattctatttccgaaattacattaaagaagtaacggtttgtaatcaatatgaatttgctcagttcctaaaagaacaagactttgattttatcttttcatcaatcgatctaccttatgaaggaaccattcctgtaatgagttttgactattttatgcggcctgaaatgatcaaaaaaatagctgatgcactgtcgactgtttttaccgttgaaaaacttttgaccttctttaaggaaccgctgtttatttgtgaccaagactttgaaacaaaagaagaagtgctgcattttttatgtcattgcattaacgaacaatatcagatgccaaataattttgaagctttggtatttgaacgagaagctttttttggaaccgatttcttgccgatggttgcttttccacaccccaatgtattgattggatcggaaacagtgattgctgttgcccatttgaagaaaccaatattttggtataaacaatcggttcgtttggtcttcttactagtcattgctgagcaagaccatttaaaggctaagtcgctaaacgatcatttgatcaaaatatgtacatcatctgagaaagtgaacgaactgattgcgacgaatgacttcatcacatttatccatcacttaaaggagtagattatgacagacaaaaaaatcaaactatcaggagcatacaattttcgcgattttggcggctaccgtaacaaagaaggaaagcgtctcatacgtgggcgactctatcgttctgatgaattaagcaagattacagctgcagatcaagaaaagttagtacaacttggaatcagtaagatcattgattatcgaaataaaaaggaaagactgaataatgaagatcggccgatcggtaatgcagagattctttatttgacacccattgcggatattgctgccctagcttcttctgaacatgatgaagaaagtgcactttctccccaaaaaatgacggcggctctggcaaaagaattaatgatccgtcagaatgaagaatttgttgaaaataaacagtgtcaagacgtttatagagaagtcttagaaattcacttagctgaagagggggcaatcgtccaacattgccgtggagggaaagatcgcactggttatggcgtcgctctcattcaattactacttggcgtcagtgaagcagatgtgttgcatgactatctcttaaccaatgtatacaaaaaagaaaaaaatgagaaaagcctgcagctgttgcttcaagagaccgataatcccgattttgttcaggcgatgcgctattttaaagaagctgatcgtcattttttgcagaatgcattggcgcgaatcggagcttatggtggagttgagggctatgtggtcaacaaacttggtttttcccaacaaaaaatccgcttgttaagagaaaaatacttacaaaattaaggataggaggatattatgaatacgtttaagaataaggtgttggcgggagcaattaaggtgcaaaataatgtttatatgaaagcgatctctaatgccatgatggggttaatgccgattatgatgatcagttcgattgcttctttaatcaatgccatcgatattggcaatacacaacaaataatggatcaaataggtcttaaatcattgttgacacaaatcaatgcgatgaccatcgatgtcatttccgtctatgttgccttcttagttggctataaactggcggaacatttgaatgcagatcaattaaacgctggcattatgagtttagtttcattcttgattttaagtcccatcgcaacattcgaagagaccaaagtgatcgagttttcgacgctgggttctagtggaatgttcgttgcaatgttcggcgggatactaggtgcaaggatttatattctatgtgtggaaaagaatctgacaatcaaaatgccagactcagtcccaccaattgtcaataagtcctttgctgcaatcgttcctggagtgattgtttccacgatcatggggattatttatgttgtaatagcagctactccatatggaacgttaacagatatgatctacacgtgggttcaagcaccgctaaccttattgggtgccaatgtgtttgcttgcatgattattgtggcatttattgaattcctatggtttttcggtatccatggtgtattagctgtctatccagtgttgatgctggtcttttatcaacctatgctagacaacttggctgcctatagtgctggccaaccattgccacatttgtttaccattggttttatactcaacaatcgcggcgctcgttcctttgcagtagctttattagccattttcagttgcaaatcagaacagctcaaagctgttgggaaaattggattgattccttctatgtttggaatctcagagccaatcaaatttgggattccgcaggtgatgaacataaggatgttgataccacttatggtaacaccagctgtttctgttttatcagcttatttattaacgattgttggctttatgccttatcataatggcgtcaatatcccaacaggatttccaatcatttttggcggtttcttaacgaatggctggcaagggattatcgctcagctgatccaatttgtgttatgcgtgctgatttatattcctttcatgcgctggcaagataaagcagcactggcagaagaaggaaaaattgcgcaagcataacaagtactgacagcctataaattaaaattaagtgggggatttaagatgaaaaagatcgttttagtttgtgctggtggaatgtctactggtgtcttagtaaataatatgaaacaagcagctcaaaaaaaagctattccagtatcgattgacgcattttcaatcgaatcggtagctagtgtggctaaagatgcagattgtgtgttattaggtccacaggtttcttatcgtttagcagaagttcaagggttagtggcttgcccaacagcttctattgatatgcgaacttacggtatgatggacggacaaaaagcactagaacaagcgctggaattgataggagagtaagatggaagaaaaagaacaaatttgttttcaaattatttccgaagctgggatggcaagaagttgctttttcgaaagtattcaacaaatgcgaaaagagcaaacaaaagaggccctatctgcgattgaaagtggcaagagtcattatcacaaagcacatattgctcatcggcaattggtacagcaagaagcacaaggtgataaagtttggatgtcgttgttattgagtcacgccgaggacttgttaatgagtgcagatattatgagtgagttggccaaagagttcaatttactttatgaagaagtaaatgggctaaagcagatgattgatcagcatatttcttcattgaacacaaaagaataacaatcaaagaagaaagacgtctacgatgagacgattcgagtgaaatcgtggacgtcttttcttggtctatggcaggtggaacatttttctaggaaaaaagataaaaaaagctggtctcaaaacggagcaggcaagaaaagtggattaccaaagcaaatggcactatctctttgagaggatgggatgcatggactcgttcaaagaagtaaaaaagcaaaagaaacatacgaagaacagctcccccatttcttccgttaagaagaaacgggggaaagctggttttcattaaaaaagcccctttttcaggggccagtagggatgatctttctaggaccattccacattcgctcgtttctcaaaggaatagtttattttttcaaggtatacccttggtctagtaacattttttccgttcgttccatgctgatgccatttgaagtatcaccttcaaatgtgacccctggcaattgctttgccgcatcgtagtctaaattactgtaatcgatcgtcaatgattcggttgctgcatcttctccgtaatcaagcgaataatcgatacccttgattgcctgatactgtttggcgatcggatccaataattgttttgcttcctctttcgtagatacgccaacagaagaataaggcatgatattgttggcggtttgctttttcacttcgtcaccttcgtaattgaagaccaactccatttgaactccgttttgttcattcgtgaatgtcttggttttttgactcgctccatttgctccgcaacttgctaaaaagaatatacccaacaacgctataaatcccactactgtttttttcattctatccctcctttttttcatgatagtatactccacctgccagagctattcatatgctcaaaaacaaatagtctttttttgtccgataggcaatccatatcgtcagcgggaaaatgataaattgttgaaaaagttcgtgaattttttctcgaattttcagaagtattcttgttattgtatgcaaacaaatgtaagacgagaggctagtttcacaaagttttttcagaaaagaaaatgaaaagcaaagaatttttaatttgtgcaatcttttattgaaaagagaattacatcttttagtagcaaatactgcaaatgtttgctaaaatagcagtgtcggttaagcattgcttaacaaataaagttttttaaaacttaggaggaattttttatgccagtagtatcaggagctgaattcttaaaagctgctcgtcaaggcggatatgcagtaggtggattcaatacaaataacttagaatggactcaagcgattttagaagctgctgaagcgaaaaaagcgccagttcttattcaaacttctatgggtgctgcaaaatacatgggcggatacaaacttgctaaagatcttatctgtgatctagttgaatcaatgaacatcactgttccagttgcgattcacttagaccatggtgactacgatgcagcaatggaatgtatcgaagttggctatacttcagttatgttcgatggttctcatttaccattcgaagaaaacttgaaattggctaaagaagttgttgaaaaagcacatgctaaaggcgtttctgttgaatgtgaagttggttcaatcggtggtgaagaagatggcatcatcggagctggtgaattagcagacatcgaagaatgtaaacaaatggttgcaactggtattgattacctagcttgcggaattggtaacattcatggacaatacccagaaaactggcaaggacttgcttttgaccacttacaagcaatcgctgatgctgtaggttctgatgttcctttagtattacacggtggttctggtattcctcaagaacaaatcgaaaaagcaatttcaatgggtgtttctaaagtaaacgtaaatactgaattccaattgtcattcgcaaaagcaacacgtgaatatatcgaagctggtaaagaccaagaaggtaaaggttttgaccctcgtaaactattggcaccaggtaaagctgcaatcatcaaagatgcagaagaacacattgactggttcggttcagctggtaaagcttaattctttcagttcaaaagaacgatcacaagtgatcgttctttttttgtggggaaatcctgcttttttctttgtctgttctatgctaaaattggcatgatacacacaaactctaaagtataggtggatatagatgaaaaaaattgtcattcaaggcaatcgtcccttaaaaggagaagtgacgatcagcggggcaaaaaatagtgcagtagcgttgattcctgcggcgattttggctgattctcctgtcgtattagaaggggtgccggatattcaagacgtgcactcattgattgaaattttagaaattatgggtgttcaaacgcactttgaagaaaacacactgacgatcgatccaaccgagatcgtttcgattccgatgccaagcggcaaaatcaatagtttacgcgcttcttattatttcatgggcgcattgttaggcaagttcggtgaaggagtcgtgggcttacctggcggctgtttcctaggtcctcgtccgatcgatctgcatatcaagggattcgaggcgttaggggctacggttacgaatgagcatggcgcgatgtatttgcgtacaagtgaagcggggcttgccggagaacggattttcttggatatggtatctatcggagcgacgatcaatgtcatgttggcagctgtcaaagctaaaggcaagacgatcatcgaaaatgccgctcgcgaacctgagatcattgatgtggcaactttgctgaacaacatgggagccaagatccgtggggcaggcaccaacgagatccgcattgaaggcgtccaagaattacacggttgccgccattcgatcattcccgatcggattgaagcaggcacttatctttctttggcggcagcagccggtgaaggaatcaccatcaaaaatgtcatttatgagcatcttgaaagctacatcgctaaattagaagaaattggtgtgcgcatggatatcagtgaagatgaaatctatgtttatccatcgaaagatttaaagccagccaatgtaaaaacatacccataccctggttttgctaccgacttgcaacaaccgatcactcccttacttttgaaagcaaatggcacgtcagaaattttggatacaatctatgcaaaacgtgtcaatcacataccagaacttgcacggatgggtgcgcaagcaacaacggaaggcaatttgatcttgctcaacggaccgagccagcttcatggcgcagaagtcgttgcatcagacttgcgagcaggagcttgtttagtaattgctggactgatggctacgggaaccaccacagtcttcaatgtcgaatatattttacggggatatgatcatataatcgataaacttacagccttaggggctgacattcaaatggtagaggagtaactatgagcgactatctaacaatggcagaactggagaacaaaacgctaaaagaaatctacacgtttgccaaagaatttcgaattccttattacagccaaatgaacaaaaaagaattatcactggctgttattcgggcccaagcagaaaaacagggtttcttttatatggaaggtatccttgatatcgttggacaggaaggttatggctttttgcgtccaatcaattatggccccagtgcagaagatatctatatttcttcttctcagattcgccgcttcagtttgcgaaatggcgacaaagtagcggggaaagcgagaccgccaaaagagtcagaacgttattatggtttgatgcatgtagaatctgtgaatggcaaagatccggaagaagcaaaagaacgaccgcacttccctgcattgacgccgctttatccgaatcgtcatttgaaattggaaactacccctggtcgtctgtcaacacggatgatcgacatgctggcgccggttggctttggtcaacggggattgatcgttgccccgccgaaagccgggaagactagtatattaaaagaaatcgctaacgggatcactgacaatcacccggatgtagagttgatcgtcttattgattgatgaacgcccggaagaagtgacggatttggaacgaagtgtcaaaggagatgttgtttcttcgacctttgatctgcagcctagcaaccatactcgggtctctgaattggttttggagcgtgccatgcgtttagttgaagacaagcgtgatgttgtgatactgatggatagtatcacgcgtttagcgcgtgcctataacttagtcgtgccaccaagcggccgtacattgagtggcgggatcgatccagccgcattatacaaaccgaagaaatttttcggagctgctcggaatatcgaagaaggtggcagtctgacgattttagccactgcgttagttgataccggcagccgaatggatgatgttatctacgaagagttcaaaggaaccggaaacatggaactgcagctctctcgcagtttagccgagcgtcgtattttcccagccatcgatatcaagaaatccggtaccagaaaagaagagctcttgatgagcagcgaacaattagaagagacttggcgcttgcgcaataatatgactggtgactcattagaattcacggaacaattcctacagtttttaagaaaaacaaaaaccaatgcggatttcttgtctgcttttcatgacgtacattttggcgataaacggccaaaaagaaatctaaaaagataattgcatcgaaaaacgaaacatggtaagatagtcatgttgtaaaatcgacaaatcaactctggtacagcaaatggaccagggcaaaggagagaagaagaaatgaaacaagatatccatccagattatcatccagttgtattcatggactcaactactggtttcaaattcttatcaggttcaacaaagaattcacaagaaactgttgagtgggaagatggcaacacgtatccattgatccgtgtcgaagtaacatctgattcacatccattctacactggacgtcaaaaattcacacaagcagatggacgtgtggaccgtttcaacaaaaaatacggtctcaaagacgcgaacgctgcggaataagaaaaacgctgatataccaacgtttagcagactatctgatagggatagtctgctttttttcgcttttgaccatacttttgaccttctgcaaacttccttgtttttcctctgtggaactcatgaaatctgcaaaacgatttgccgtttcttccgtctgtcttttcgtgacatgggtgtagatatccatagtcgttttaatatctgtatgtccaagtcgaacttgaacttctttgagtgaagcaccggattcaaagagtaaactacaatgagtgtgtcgaaacccatgaggtgtgattcgttttaagttattctcttttataatgatttttaagttgtgatttacatagtctaaataaagcggtttattttcttctgatacaaataggagctgttcaccattttttgccggtttgattcccatttttagaaaatattctttttgcttcaattgccattgtttaatcacttgtaatgtttcagagtctatcgaaattgttcgaaggctcttttctgttttgggaacttggaatttgacttcccatttatcacatgtggctaaggtttgtttgacggaaagggttcttttttcaaaatcaatgtctttccaacgtaaagctaagagttcacctttacgtaatcctgtaaaagctaaaatccgaaaaattggataaataggatctggatagttttttgcaatttcgaggaactccaatagttcttccttttcatagtaaggtgcggaatagcgttcttcgtcaattcgctttttacgttttggacgaattacagcatccatggggttacttcgaatgagctgtaaactcaaagcatacttgaaaaccgatgaagtcaaaccaattaagttggaatatttcttgtaatagctataccaatgatttacttgtttttgacagtatggaattgaaattcttgagattttcaaattgccaaaaagagggaagatatgctttttgtaagctaatttttgggcgacataggtactttcacgaaccgtatttttgtattgttcaaaccactcatctgccaattctgaaaaaaggcgttgtgaatctgtcactacatcattttcttctacttgcaccatcaagcgattgtaagcttttctggcttctttcggtgatttaaacccacgcttggtggtgtatttcttttttcctgtaacaggatcaatgccaagataggctttgaacatataggcgattgtgccatttttcttttgatattttttgatcataattgtctcctttgattcactcgccagtatatcaaagagaagatttactcctttcttatgggtatcataggcagccacaacaggtaagtcaaggctagatttttagactatctaaaaatagttttacatcctcacggtcaaatcgagtttctttcccaaaaggaatgatttttaaaccatgattaatccaactattgaggcgagtatccccaatttttaggtgttgttttaattgtttccttgttggatagggaggcaactcgtttaagtttggttgttgcgtttgttcttcctcaattttttgcttcgttaattgaacaagttcttcaattatttcttgattaaattcaatcggtacagtaacagtcatatttttacctactttcgagattcatttttttatttttgtatagcgaacaatgctttcttgaaaatccatcccttgttcaggatttccaccttcatttatcgcactgtaaaatatcggacgtcttacgagatactcattggtataaagtacgtcttgatttgtggtatcaaaaggttgatccacgagttgctttgtgacgttgggcactttgaggttgcgcgatttgaagaacgccttttttttatgctctttcaaatccaagtctttatcgaagtatttactaatatagcgtccacgattttcgatactatctacatcaatcttgttgattttgacaaatccatgtttccagatggttgtaaggcgattgacggagataaaaggaaaatcaaataaaatgatgtggtaatggatggcacctcgttcttgtttttcccacgtggcaaggtattttaggtttgctttttttgtgtgatagagttcgtagtttagtcgtttgataaattttttaaattcattattcgcatgggcaatgtcttgaatgttttctctgaaagtgagggttaaaaattttgtctgattgtcaaagttcatatccacgagtcgggcaatttcaaagcgcatattttgatagtatttttgttttcgttttaagctgtcgtattgcccttgagcagataggtcatcatagttttttcttttatcagtagtcgtattttcttcttcataaagccaggctagttctttttttcgttttggattggtttcaatattttctgttttttgtttaggagtaatgattgcttcataatcataaatttcaaggtacgtgggagtttcaatgattttttgattataagctttcaaaaatcatcactccttgatgtgtattcagttgtcaaagaaccatcattcttcgcctgatgttgttctataaatcaagttaaggggaagtcctgcaaagcagtccttccagcctatgtgtttattgggcggtcttaacggacagaagcggctctatggcgctgccccgccgtttcgtcctaaccacccaacaaactcataggaaaactagttttgcgtagtggggccttgttttttcggaagcaaagttgccgcatctgccgtggccgataagccatagctgacgaattgaccgttagagcgcccccaaggtgcaatcactaagttggtaaatgtaaccatggctaaaccttgttgggtaagctcttccggtgtaattacaggatgttcagatttgactttgacactgattttttcgtagcggagtttaggtaggatacattcgtaactccaacctagaatttctccgtctttttgccagcgagtaacgttgacgacttggtattctttctcgagtttttcttttggtaaagtgagatcattgattttaattggcataatagccctcctttttatatatacgataatttatacgattaggttaaaaaaatatagacggccatctatgatttgtattttatacgtttgtttatacggagtcaagaggtttagaaaaaaagatatacgaaattttatacgagtgatataataggggaaaatgacaaggaggaagtaatctatgtttggcttattacaaccggataaagtgaaggtaggacaacgaatcaaagaaatcaaagagagtatgaatctgtcctttacagagttgggcaatcgcttagggataaagaaaccaacgattagctcctatgttcaaggctatgcactggcccctgaaagtgtcattaaccagttatctagtatcagtgggaaaccagtaggctggttttactttggtgatattgaagaatatattgcggactatttgcagctaaaagggcagaataggattgtgcaagaacatccagaagttgtgaaaggaattaaagaagagttttacactgggcagtttaaaaatccggcatgggaaaatgaagttggttatccatgtgaggagtttatggatgattatttttatgaactgcaacaagaagtcattaaagaagaaattcaaaaaatggtacgtgatcagataaaaaatttaccgattgccgatgaattatctaaacagaagaaagatgaggcagtcaccgttattacgagcggtatcatcgaatacatggatgtagcaggtgaatttaattatgaaaaaaaagatgatatgattaaactggttaagcaggaagtcgataattacgatttttttgcggatagtaattttgaagatcagtatttagtggggaaactaataaatatcttggcagatcagcagaaaaccagcgaattaatcaaccatttatctgaagagctgacagataaggcatttataggattatttggtggggaagagttggtgaaaacaattcagacgttaagaccggcgttaattaatctgtccaataaaattagtgcagatcagcttgaggattggtttgaaaagtaaaaaaataattgaaattaggagttgatgataggccactaggtgatcaattgaggttgaaccgacaacggatagggctatactatcgagaagatataaattgacttactattcccggtcagattatttcaaaaaaattatatgctcaaatttgcatggtataatcactgatagataacataaggtatatttcagttttttaattgtgaaaagacgataagacattattttatattatcgaaaatcaatcaggttgttttgaaatattgcggatattgtttcgtctttatctattaaaatgttcataaatacaccaatttgttcaaaaggagatcatagataatggatgatatatggatgtttatttctcatttgaaaaaacaataccagaagttaggagtggtagtatctagccaagataaagaaattaatatggatagagtggaattcgtaaatttgaatctacctttaagtgaattacttctgaaaaagagtcggcgaagttggtatctgactgcttctgattttatcaaaggaataatagaacaatcttcagaagaagttgttctgtttgataactttgaattgataatgaatccagaattaggtgtcaattttatggatctattgctagaactaagtaagataaaagttgttttgattgcatggcattatgatattgaagggacaactctcatatatgcacaacctgggcacaaggaataccgccgtattgaaatgagagaagatcaattatttttttggataggagaagaaaatgctgtataaagaattagtaaattttgaaccaattgattcagtcatccaattaacagatgcaaattcaacagaaaaggcaatgcacctgttggatacatacgtaatctcagatcgcatggcagaaacaattaatgaaattatttttaagcaactacaatacactagaccagaagacaacaagggattattggtcgttggtaactatggctcaggtaaatctcatttaatgtcagtaatctcaacaattgctgagtatgaaggtgctagtaagcatattgcaaataaagaagtagctgagcacgctaaacaaattgaaggacaattcaaggtaatccggtttgaaattggtggggtggatcgcccgttcaaagatattattatttcacaactcgaaaaaggctttattgaaatggatgtcaactttgaatttccagaagatgattcgaagttaaccaataataaagaatggctactggaaatgatggatgccttcaatacaaaatatccagaaaaagggttattagtagtcgtcgatgaacttctggattatcttcgttcacgtaaagagttagaaatgacattggatttagggttcttacgtgagttaggtgaagtagcgtatgatagcaggtttaggtttatggctgggattcaggagatgctattcgataacccacgtttctattatgtagcggatccactgcgacgggtaaaggaacgcttcgagcaagtacgtattgttaaagaagatattgcctatgttatttcacaacgtttacttaagaaaaatgatttacaaaaagctaaaattcgtgaacacttaacggagttttctaagctctacgaccgactaagtgagaatatggaaacatatgttgagctgtttccaattcatcctgcatatttatcgacatttgagaatgttcataatattgaaaaacggatagcattgaaaaccatcaccaatgagatgaaaaagattattaataacgaagtaccgatagatgatccaggattagtttcctatgatagttattggacatacattgaggaagacccatcttacaagacaattcctgaagttcgagaagtgatggataaagtatcaattttgaaggatagaatcaatagtgcctttccttcaacaaaaagacgctatcaaaaaatgtctattcgtatagtgaatgctatggcattgaatcgtctaactactgatgatatctattctaaggtagggatgacttctgatgaattgaaagatgacctttttctaacaattcctggtcagatggatatgctgcttgaagatcctgatcctgcgggatttttgaaaacaaatatagatgtggctattaagacaattatggaaacagtcagttatcaatatatttcagtaaatgaagtcaatgcacaatattatctagatttgaaaaaagatattgatgtagatagtctgattgcagatcgtgctgaaatcattgaagcggacacaatggaccgctactattttgatttattacaaaatgcgattgctttggatgaccttacttatatttctggttataagatttggtcatatgagcttccttgggaacaacgccgagtaatgcgaaaaggatatcttttcttgggttctcccaatgagcgatctacagcgcaaccagagagagatttttacatttacatgttacgaccatttaataccgtaaactataaagatgagaagcgctcggatgaagtcttcttcaaacttaatttagaagacgattactttgaaaagacattacgaaaatatgctgcggcaaaagagcagtacattgaaacaacacaagcacaaaaacccttatttaaagctaagtatgatagctactataagcaattgaataaatggctgttcgaacattttgtagatgtattcaaggtggtttataaaggtaaagaaggatatctttctgattttggaatgttccttccacaagaagatactttgaaagcaatggtcaactatgcttctgcagagttcttgaatgatgcctttcaagagaaatacccagattatccaacctttaaagaatataagccaggatatctaacaaatgataatatcaaaacttccgcaagtgatgccttgcaattcttaaatggacgttcaacaaaaactggggaggccatactgaacggcttggttatggaagatagtgctgggaaagtaactgccgaatccatttctagttctggcttttcacgatggattttggaaatgctagaagaaaaaggtaacggcaaggtggttaataataaggaaatatatgatcaagatgccttacgtggtacaggagatagacgtctttcaaaagagtttaaattggagcccgaattagtagttgtcgtgattggtgcgcttctttatgcaggaaaattagagataagcgtagctggaacgaactatacagcaatgaactatcgagagtttgctgccgaaaatatcgagatattgtctaatttcgactatatcaaaaagccatctggtcttccaattaatgaaatcaatgcagtactaaatctatttgatgaatacgccccaaactttgatgagaagattctagaaggatatattaggcgccttagcagcaagtcaattgaagaagtgagtcataccttaaatactattgagatggtcaagaaaggtttttctattggcggcacagaagttatggacgcaaatactcgacaagatacaattatgagactcacttcttataaagacttttgtgaaaaagtccaacggtataataccgttgctaaaatgaaaaacttttcggctagcgttactgaaatctcagaacaagaagaaaacaagaaattaattgattcaattgaacagatgaagaaagacgttgacgaagtcggtacactagtgacatacattacacaggctacttacaactatggccttgagagtgattggacaaagaatgcccaagaagcgattaatgctgtcgttgaagccgtgaagaaaggtgctggattcaagtcgcaaatggatgacttgaaagaaattaaagagcactatatagatgaatattatgatattcatcagaaatctcgattaacaagtaaagaggaaattaatcgtgatgggctacttaattcagttgaggcagatgtattagctacactaaaggccaatatcgacattcttccgggtcaacagcttattgattgggtccgagagctacgtgctacaagagcttgtttttcactaacaaaagctgaactagaacaatatccgacatgtactcattgtaatttcgaaattggaaaaactgatcggaattctaaattggttgtatctaatggtaaagaaaagttaactggaatttatgaaaattggatggagattcttgtaagtagcttacaacagggagacattgttgagaatcgggaactcttgaataatgaagaaaaagtagaaattaatcaattcattgctacaaaagaattaacatttccgattagtccccaattcttgaataccataaataatttgtttaaaggctttgagaaggttgaaataactgaagcggagctggttaaagcaatgggagacggtagtccaatgtcagttaatgaattagaaggacgtatccgtcaattgattgcagagctaactgaaggcaaagagaaaaataaagttagaattatgtttaagaggtgagtagatgtcattagaaaatgaacaattgtcttttgattctgaacaaagggaaaataaaagagtgacagttctcgggatggaatttgaaaatgatgatgctcgtcgagagtatttccgggaggaactgagaaaaaaacttcctgagttgaggaaaattgaaggttttccaataggcaatgatgaggatattattgagctgtctgatccgcctttttatactgtatgtcctaacccatttattaataggtttatcaatgaatggaaaacagaggacgttgaagagtattcaaaagaacctcttgccgtggatattagctttggtaaaaatactccaatctataacgcacatacttatcataccaaggttccgtacaaagcaataatgagttatttgcttcattatacgaaacctggcgatatagtgtatgatgcttttagtgggacaggaatgacaggtgttgcttcttcattgatgaataacaaaaaagaacttcttgaaattaagccggatattacagacaatgatattggtgttagacatgcctttctttctgatttagctccagtgggaagtgttatttctgaggtatataatagttcggttgattccgaattgctggttagtgagctaacaaaattattggctgattcaaagaaagatttaggatgggtttataaaactgaagtaaataatgttgaatatgatattaattacactgtatggagcgatgtatttagttgcccaaattgcttgacggaatttatttattatgaagaggctttcgatattgaagaaaataaattgcattctgatttttcatgtccaaactgtggcatgttattaaacaaacaaaaatctgataaagtaatgtctgagtattttgatgctgtggttggaaaaaaacttaaagttcttaaacaaaaacctgtattaattagttatggatttggtagaaataaaggaattaaaaaaataggcaataaagataaagaacttttagagaagattgataaatataatattaataaatggtttccagcattcaagttacctaagggtgatgagattgaacgagtgaagagaaatggtattgaatatacacatcagttttacacaaaaagaaacttgattgtagcaagtgatttactggaccgaatttctaaactgcctgaaagtcttaaaagaccagcatatttgtgttttcaatccatcgtatatagtcttatctcaaaactggtacgttataatatgggaaatagaggcaacgggatgcttagcgggacatactacctcccttccttaatggcagagactaatgtatataatgtttttaaaggaaaagtaaaggatatagctaaagcattgattgtgaaacaacggtcatcaattgtatttgtcagctctgcaattacaaatgagttacaagagaactcagtggattacatttttacagatcccccatttggagagaatattgattactcagagttaaattttttatgggaatcatggttaaaagtgttcacaaatagttcttcagaagcgattataaatgattcacaaaataaaggtctctttgaatataagcaacttatggaagagtcttttagaaattattttaaggttttaaaacctaatcattggattacagttgaatttagcaattctaaatctagtgtgtggaatgcaatacaagactcgattcaaaaggcaggctttataattgcagatgtctctgcacttgataaaaaacaaggaagttttaaagcggtcacgacgacaacggctgttaagcaggacttagtaatttctgcttataagcctactgaagagaatattgacaaaatgaaggcacaacgtaataatgtggaatcagcttggacgtttgttacacaacacttatcaaatcttccagtatttatgggagacaaaggtgatgcggtaatcatatcagagcgaacaccacgtattctatttgatagaatggttgcctatcatgttcaacaaggtctaccagtcccaatttcttctgctgactttcaatcaggtattgctagtcgttatccgatgcgcgatggcatggctttcttagactctcaagtggcagaatatgataaaaaacgaattcttgcaaaagagtttgctcaattgtcgctatttgtatctgatgaaaatagtgctattgaatggattcgtcaacaattaatgaaaaaaccacaatctcgacaagatattcatccgcagtttatgaaagagattcagcatattgcaaagtatgaagaattacctgagctcgatgagttattagcacaaaactttttatactatgatggagatgaggcagtaccaaatcaaattagtacctatctgacaaaaaattatcatgatttgcgtggcttagaaagagatgacgttttattaagagaaaaagcgaaaaatcgttggtatgtgccaaatcctaatcaacaagccgacttggaaaaactgcgagagaagagcttactacgtgaatttggccattatcttgatgaaatcaataatagcaagaagaaattaaaagtattccgtacagaagcaatccgtgttggttttaagaaggcgtggacagaaaaagaatatcaaactatcgtaacagtgggtgagcgtctaccagaaaaagtaatccaagaagacgataagctcttgatgtactatgataatgctttaatgcgaacagaaatgtaataaatactaattataaagaaacttgatagattctacacatagaggaagtgatgaaaatgaactggataaacgagattacagacaggttcccgcagaaaaagatttatcttgtaagagatgacgatggattactgatgatagataatgttaaggtcgaattgtctgagttagatgtttctgtaataacttatggggatccagttcattttcgttatacatacgaaactaaattcggtagaaaatttgatggaatactacttattcgcttggtagatactgattttcaagaggttccttgggacgtgtaccaaaaagcatttcgtgaatttattggaattactgatatatttcccttcttggactgtaaagctgtgaaaaagctaggcattgaaaactgggagcaattatacaatgcccagcaaagtttaacaacaagacaaaattatgtttcttcaatgaaatttatagaacgtgtgatttaccatgaagctgatgaacacatttcaatgatacttgatccttatgtcgaagatcttacgctatttaataaaaaagctccggtcttgcgtgaatggagcgagattgctagattgattggtgaacatcgcttatatcgtagaacggataaggaattcgaactattagtcgatgatgccaataaaaaatttcaagagtatttaaaaagagattatgacagaaatctttccctacctccggcaaaaaagccaaattatgttaatcaaattttgaattatttatacagaatgcaaggtatttcaaatagaaaattagctttgattgttatggatggaatgagctttactcaatggagtgttatcgaaaaatggctagttaataaaagctttgatttccgaacccaggcaactatggccatgattccaactattacctctgtttcaagacaagcaattttttctggaaaaagacctagtgagttcccagaaacaattaccagaacttcctcggagtcaattcattggcgtgaattttggaaagaaaaaggattcatcgaaaattcaatcaagtatcagaaggggctagggcacacaaactatcaagatactgttcttgagttcagatacgtgggtaccgatatctatgggtgtgtcatcgatgttgtggatggatttatgcatggtgccaagcaaggtctggagacagttcaatcagaactacgaatttggcttgagaagggattcttagagttgatgttacgtgacatgattgatttagattacgatgtatatattacatctgatcatggaaatgtggaggcaactggtattggtcgaattcaagaaggtgttcttgctatgagtaaaggtcaacgtgctcggatatatgattcaggactgcttagatcaaatatacatgactcatatactgaatcaaccaaagaatgggagagtataactttgcccaatgaaggctattttccgttaattgccaaggaaaaatttgcatttgtacctgagggagatataattatgacccatggaggaatgcacatggaagaaataattgtaccttttgtaaaagttataaaaaaggatggtcgatagatgaaaaaaatggtgggattatttcgtgtaatgacatttgaagagttggacaaagctgctgaagtaatggtgaaatattcacctacagacgcatatcaaatattagatgagacctttgccaaaataattaaaggggatacgtttcgcagaaaagctctaaacaatttaatgaacgtatgggggaacggacaaaaaccactttctgattttcaagagaaagtactaaaacaatatgctatttcaaattacgatgagaaaaaaacattgcaagttttgatgctgctttattctttttcatttttttcagacaccataaatataattgggaagtatctacgtatgcaggatacttttcaatcaaaaacgattatggaagaagttcgtagcacttatggaatgactgagacagtgaataaaggtttattgacggtgttaggttccttggttgattggggatttctattacggagcaagcctggtgtatatgaaattatcaatcacaaaattctgattactgacgagtttataaagaacgtgttgatacgctctattttagcccatagagatgttgaataccttccactagaaattataaataatcaagcgggattatttatgtttgattaccaagttagcagattagaagttcgtcatgatgatttaaatgtgttacgagaaagaacggatactttcatagggttaaagtaacgattatatgaattgaaagcaaaaaacaattgtaagctttacatcagtaatttagggaatttagcaattcgttttgcgaaatgttttttttgagttgacaccattccggcttatatctttttgagacaatttacgataggcaatttcaccgattggtatttgaatgacgctttgtttatttacgtagggtctcgttatgctggtattggtatcgctgtgagtcaatgccacagaagtctgtcccagagctacatcagattatttggtaaaatgctgtttttctattgtagtcattgtgctataattaactagctaatactagcaatcatattgttgagtattaggaaatttgtataacaaagtaaagtgatttgacttcaacagaagtaatttgcctgacgtatacagagcttaatcttaatattaatattaagctctgcatactaagtatggtaaccaagactgtcagaagaaccatttcgcacctccaagagtaataatctgttggagaaactttcttagttatattatatactatttgtattttgtgagaatttctcaccccgccatattacagatgcggtaatagccttatttggcagaagtagagcctaggggtcgcgccttaggcagtgtgcaaagtaaattatatagtagcgggactaaatttactgttgttgctccaataaaattagttgaccgagggactcaaaatgaataaagatgtttataaatattcaacaaaaaaatatcttcattttgacaaaatcactagttttaattcaaaggtagaaaagtatgtgtatgagtttgaaaaaaatcctacacatagtttcttacctttgatttttaatgaaatcaatattgaaaaatttagagacttaaaagatgatcctgaaaatgaaaataaaagtagaaatggacggaaagtccctgtcaaagaaaaaaatagaccaattatgtacgcatctcatatagataattatatatataagcattatggactacagttaaatgaattgtataatatctatgtaagcgaaaaaaattttgatagttctgttttagcatataggactaacaaacatggtaaaaataatgttcatttcgcagcggaagtaattaattttatagcagagcatcctaattcttttgtttacgtaggagattacacaggcttttttgataacttagatcatgaatatcttaaacgaatgattaatcgtttatactgtgataatagaatgccagatcatcaatttaagatttataaaagtttgacaaaatattcgtacattcacaaggaagatataaactatttcgttgctccagataaggaaatttatgctagtagaaaaaattcttattttgctagttttgctgactttaggcgtttcaaaaaaatgaaaagtcattattttagtgatggaaaaatagttgttagaacaaataatgatgaaaaaggaatccctcaagggacggcaataagtgcgatatattcaaatatatatatgctggaaatagatgaatctatttccagtttagtaaataattatggcggaatttatcgaagatattcagatgattttattatcattttgcctgacataagtgaagaattattcgatagtttaaggcaagaaatagaaaataatattttcgataaaactaaaatgtctattcaaaaagaaaaaactaatataatgtattttgatggtaaagtattgagaagagtaaatgcgcatacgatgactaagctagactatttaggttttgtatttgatggaacaaatgtgaagatgagggaaaaaagtattactaagttttatagaactgcatataaattaattaaaaaaggagaaattgtctccagacagaaacgacatattggtgacaaaatgcgtttaacatataaacgtaaattatatcaaaattatcatcaacttggagaacgcactgatattaagtatcactataagcaaagggaatttggaacttttattacatatgctcgaaaatcccagaaaatctttgatatattatccccaatgacttgcaacctcatggcttttcaaataagaaatcatcaaaaaaatattcagagaaaaataagagatgctgaaaaaaatttatagcataaacaatatttcggctcgcatatttttgtttaacaaattgacaccattgctttcaaataatttgaaagtcaataaagtttttcgtgtttcattctctttaaaactttgctattaaaggattgtaaagctatttgaaaaaatggttgggctaaccaggtcttaagaaagctcgtaaagcttcataggtttttagtattaatatttgctttataccaataagacatttcacatctaagtttgtgaagcatattcttattgttgatacctttgttgatcctattttgattcgtagcttttagtgacaatttgtggtagtcaatcaccttgacaggcacaatgatcacgtttgtggcgtatgaatggactaatagattccatgatttggaattattgatataataagggaaaatttaacaaagcaaacgtttgttattgatgatatgtataggggcgtgaaaagaagtgtctaaaaaagcaaagaagagtaacaatcctttcttcaatctagcttctgagcagtttgaagaactcaatgatgaattttacaagaattacaacaaagattattattcaataaaattagattctttactcaaaatgattgagtcctcggaatcttactgtaaagggtcaaatatgaaagtaggcattttagaatatgaaagatcttttgaagaagaagaaattttaaaatatgcaaaaacagaattggcggtaacagttttccattgtttggaatcttttttacgtttgtacatggcacattgctctatgagaggatgtccttggttagatttagcggacatgaccttaacaaaatataataacaacatacagaaattgaaaaagcaagtctataatatttttaatttatctgactttaccgatgatgaaattattactgctgtattttatggaagtaagagtgtcccagcggagattattgataagacaaatttgactgaaaaagaaatagtagagcgttttaaaaggtatattcaatttgcggtaacatatctggataacagacaggattataactcttacaagcatgggctacaaataacgcaaaaagaaaatgggttctcttatggtggtacaagaggaacgaatgaaattttatcagtacatggtgattcattaacatatttacaagtaaaaaaagatgacaagaataataaaagatgggttaaaactactaaatggattgattacaaacaacaggcaacacttatattcttttttaatctattaattgctgatgttattgatatttggtcacctgatagggaaaagtatctcaaaactttcccaattgttgtaaccattgaagagcttctagaaaatcgtgaaaactacgtcggtggaaaaataggccgagaaatagaggggttccaagttacagaaatgtcaaggggacttctttattatgaaaatgattagttcagttaaaggaatgctattctgtgatacttaatctgatcgaaaagtcatcaatttcaaagttagcaaattgtacatgacaaaatcgtttcaattcgcatggttttctcgttaaatcgatattatggatttaatattatttgaaaacagttgaaattttacagtgcaagttaggtaatactctttgatattaatggcttttaaagcgtatataaaatctgagtaaatgaatcaggttttacaaaaacggataaaacatcttaactcatatgaaaagtataatatactggcgagtattttttgaccatacttttgaccttctcaatcaaattttactgggttgcattagatttttaaattcctcaagaatcccgtatttacactgttttctgtttattagatatcactagagagcaatccagctctcaatacggtctcaaagacgcgaacgctgcggaataattctaacaaggttagaacgttggtttatcaacgatttagagatgttttccttcactggagacatctctttttttgcgcatgttgcgtttcttgttgcgatattatttaaacttagttcgtcatgaattgtgcaaagcgattacctgtctcttcccgctttttatcagttacatgagcatatacattcattgttgtttttatatctgtatgccccatgcgctcttgaacttctttgataggtacgccagattcaagtaggagactgcaatgagtgtgacgaaatccatgaactgtcatatattctaagttattatctttaagaattttcgttagtcgatgatttaaaaaatcaagatataaaactttgttttcttctgaggtaaaaagtaattgttcttcattatcatgttttatccctagtttgaagaaaagctctttttgctgtaatttccaacgtttcaaaagtttgagtgtctcatcatctaaagataactctctgacactttttcttgtcttaggggtttgaaaaattaatttccaaccatcagcagtagcaagcgtctgtttaacagacaaggttcctcgaccaaaacttatatctttccaacgtaaggcatgtagctcacctttcctaagtccggtaaatgctagaattctaaacatcaggaattcagaaaaaggcaactgtttttttgctttatctagaaaagtaatcaattgtttttggctgtagtagggcgctgcataatcctcttgatcaatgtccatttgtcttttgggtcgaattacaccattcattgggttattagtaagcaagcgtacactaatagcatactgaaagatttgagaagtaatcataatcaaattattgaactttttgtaatagctgaaccaatgatttactttagactgacaataagggatagttatcttgttgatcggaatttttccgaaatgaggtatgatatgcttctttagagcaaatttttgagcagtaagtgtacttgctttcacagtattcttatactgttctaaccacatttctgctactttttcaaagtgaaggttactatcaaaaataaaatcagcgctttttgattttagaagcaatcgagataaagcaagatttgccgcttgtcttgttttaaaaccactacaattagtttttatttctttaccagttaatgggtctttaccaaggtaaacatgaaatttataggcaatttcaccattcttctttttatatttctttattttcgccataaatatattatcgtcctttcttgtccgccagcatgtcgaacgagtggcatcactcctttcaatttggtataattgggtatagcaaataagcattaggtttatttggttttagcacgctctcgctttggtcggtggggcgtgtttttttattgtgcagaagtcatatatgcatcagtaattaattctgcttgttccatatagacatcggtcaatttcgtagcccaatcttcgtaatcttcatatttcccagatccgctagtcaaatgaacatttgccatttcctgtattccttcattggaaatttcagccaactcacttattttgtcgtttgacaattctgctaaaccttctactccgttttgattattaggatattcagcattgtattcatcaactaacttcggtgctgcttctttaattttttgagtgtattcgtctagaatagcttgatattgttcatcagcgcttttgctctcttcttttggagcttggctttctgatgaagctttttctgatgttttatctgatgtcgaagttgcttcttttgagctggtagatgttttctcagcagagtttttatctttagaattacccccaagagatccgccaactgcagcaactagaattaccactaaaatccagaaccatacctttttgtaaaagggtttttttaccttatacaatttaccatcttcgcctctaactctttttgccatttttatttcctcgattctttgatataatatatttgtactgtctcagaaatgaggttagggcttttagaagttggagcttctaagagctttctttttttagcaaaatattttcatgggttcaacgaaaatagattcgctgtcaaaagtaaaaatataattatgatgaaagtgttttgttccgtatttattattccatacgttcaacgcacattctagaagatatggtatagagatacaagtatctctataccatatcttcgtgctttcattcttctttccacacactaggaactgtaggaataaataacgtccttactaaaagaaatcgctcttttagtaaggattatgggcggctcaaagttattacatgtgtacaaaaaataaagaaaagaccatttttgcaataaaggaaccagcaaaaaaagcgagaacaatcaacataattttccaaggttttaaccaaacactattctttttcatctaatcacctctataaaaagaataccatgataaataaataatatcaaaaaaaattgatacttaatcagttattcaccaaatcaggcaactaacgagatgaaatcagaatcagttttgcttttcagagtttttaagttttattgctcgtattaggtggacacaaaagctcgcaaaaaataaaagccctgcaatttttggaatggcaccaattgaagctaaaaataaaaaagctgctataaagtttacacaagcggctagcaggtaaaggtagaaactagtttttcttttcaaagtgctcactccttttgaacagcatatcatactttattttcaatgtgaaaaaataatgtcaaagaaagtcgaaataaataatttcactatccgacgaaataaaaaagaaatagaaagaacttctatttcttcgagcgatttttattcgaatacagggcaatgattatagctacggctatgcaaaagattaatacttttaacatattcacacatcctttttagattagtttaaattataactttctaaaaatatatagggctttaggcctgttagtaaaagataattcagtcccacaagttatcgaactcttttttcgagttttcttacaattggatggttctatttttttcaaataactgttaaaacaaaaaagtgaagaaactactggaactaaaagtttcttcactactcatcaagtaatcaataaacctttgtttattcaaatatgtaacatctaaattttttgaagcaaggaaaaacaaacatacagaacaatagaaagagttgaaaaagtaagataatcgttaaattgacagttccgtaacgctggtaaaggtagatatgtacgagtaattcaccaagattcatgagaatcaagataagataactactcgcttttacttggcatctttttagtagatgatagctgatgtaataatcgagtaggacacaaaaaagtaataatagtttgtttaaagccgtgatggtagcatgttgttcggcaagctgttgaaagaacaaaagagctgtgggaaaagggatataaatgattaataaagaaaaaatatacaacaaaaggcatgttcacactcctaaaaaaaaaattaccaaaaggcagaaaataatttagcaaatttttattcagaggtcaacagtaggatttgttatctcaatgattcgagcattaggcatgattgtttttgcttaagaaatgaaatcttggtttacagactgaggaaaattgcggtgattttctgtcacggaggaatgcaccttgataaaccccgtcacaataaggttataagaggggttgaatattattattaaaacaatgtataaataaaaaaactcctgaaagcagagtggagaagacagttactcttgagttcagaagtttttggtttttgaaaaaaatcaattttatcaatgaaaaatgttatttttgtgcatttaatttttttaatacatcagctggcacatctttttcagcgacctcattcggtccggagatgatacgtttttgactgatctctgctttaactagtgtgttaggagcataaggctggatatcttcaccagacaattcataggtcatttcttgtctttcgccattttctttaacaaattcaaacgtatatttataagaagaatagccttcgattttttttcctgaaccgtctactgtttgtttcctttcaggtgtttcttttggtgtgcgtgcataggcagtgactccttgataggtctcagaatagtatttataactaaaatagcctcctacaccaagtgcgactacaagaagagcaagcatcatttttttcataattaaccctcatttcttttttgctgagacgactataacacggactagcttaaaaaatttattgaaaaagataacactattgtaagcttttgattatttacatgaaaatatagctgtaattttctgtcgaggaattgtgatagaagaaaatagaattgaaatcattttgcaatattgtaatgttaatcttttatttgtgcctggggagaggtacaaatacacaaaaagagaggttttttcatttgaaaaaatttgtattcacagctgttgcaggactaggtttatttatcggaggcactgttgcatctgcagaggaacaaacccatgtggttgctccaggagacacactgtcaggattagcaactgaatatggtacgacagtggatgaccttttagcattgaatgaatccattcaagaccctaatttgatttttgatggcgaaacattgctgatttttagtgatgcacaaccgatgacacgcgcgcaagaaacgacagaaacagcgcaagcgcaaactgaaacagcgccggcagctacacaatcaaacgctgctagcactagcgctgcaagtacaccaagtactggttcaggagtcttgaatccagtggacggtatcaattactataatggtgtcagagaatcttattattcacaaaaagtattagctgggggcggcttaaatattcctggccgacatgttgccgctgacggaacgatccgtgatgcagatggttatatcgttgtagctagtgacaatcaagccaaaggctcaacagggcaatcttctttgggtgcctacaaagtctatgatacaggcgttggtcacagcggaatcgacgtttacacaaactggtaatcagcaaaaacagttgcatgaaatatgcagctgtttttttgttatggtctagactaattcttgtcaaaaaaatgagagtgtggtatcattggactataccaaaacgaaatgaggagcgtatcatggaaattattcgcgtgaaagatgcagctgaaggtgggaaaaaggcatttgaattgattcagcaaggcgttgaaaacggcgctaaagttcttggattggcgacaggcagtacgccagaaacattgtatgcagagatgacagctagcgatgtcgatttttcaaacatgacttctgttaatttagatgaatatgtcggacttggcggcgaagatgatcaaagttatcgccactttatgaatgctcatttatttgacaaaaaaccattcaaggaaacctttgtaccgaatggaaaagccgaagatttgcaagcggaatgcaaacgatacgatgaagtgatcgcggaacatccagttgacatccaaatcttaggaattggtcagaacggtcacattggcttcaatgaacctggggcatcttttgatggcacaacatcagtcgttgatttgactgaatcaacgatcaatgccaacaaacgctattttgacaaggtagaagatgtacccactactgcaatctcaatgggcatcggttcaattttgaaaggtaaaaaaattattttgatggcctttggaccagctaaagcggacgcaatccaagggatgattgaaggtccggtaacgacggatctgcctgcatctgctttgcaaaatcatccagatgtcacagtcatcgtggatgaagcagcggcagccaatctctaacatcaattagttggcagagcgtccaatctaatcgacaaaatccgaatgaacatcggaaaaaccagctacttccccatttcatccagtcggatgaaaagttggtattttcgatgattcttcggtttttttatttttcatggaatacagcttaaagatggggtgcggaatttggaccttccttttttcatttttaaaaatagatggtatagttgaaaaggggtgtttcaatggttgatatggtcttatcgattccagaaattattcttagactcgttttagcaatggtcatgggaggcgctatcggttttgagcgacagtacaaaagtcggccagcgggattacggacccatattttagtctgtatgggggcatgtgtcattgcattgatccaagtagagatcgctagtggggcgatgcgtgatgcgttgaatcatccagatctcgcaggggtcattcgttcagatgaagctcgattgatcgcacaagtggtaagtggggttggttttttgggtgccgggacgattatcgtgacaaaacgctcggtaactggattgacgacagctgcttcattatgggcgattgctggcttagggattgcgatcggcatgggattttatgcgatttcgattactagttttgccgggatcttttttgcactgacggtgatcaagcgaattgtgcgagtcccgacagccaaaaaattggagattcaatacattcatcgtgcggaaacaaaggaatttttgacagagtattttcttgatcgaaaaatcgtgatcgaagatgtcaactttgatgtgaagttcatggaagactatcggatctataccaatatttatacgatcaacttaccgtgggggctgagtttctctgatgttatcgaagaattatcagtttataaaaatatcactaagctgcggttggttgatgttagttaaaaaagtactgccaaaggtcacacctttggcagtacttttttagttaggaaagaaacatgcgatcccgacaatcgctagattgctaagaaagttgactgcttcatttgtgatcaaagcatagccatgcacttttttcgttggctgctggtgatggcttttttgttcggtaaattgatgacaaaccgtgcattggtaacgtacttgaatcgttgctcccaataaactatcgattatactaccgctaaatcctaacaagagtacccaaatcaatgctgtcaaagagagcggttggccgctgagccagagacagatcgccagaagtaaaacgataccgccgctgcccgcaaaagaagcaatggtacctaggaggctgacaccgccagaaagacccgcaggtaatttttttcccgttaagagatttcggggtgcctttttgctcaaaacaccgatctctgatccccaagtgtcggcggtacagctagcgatcccgacaataaatgcccagagataattctcattgttgaaagaggcgtaaccgatcaatgccaataaactaggcgataaattagccagcacttggatggcttcgcggcgcgcacctttgatcaccagatcatcggctgagttttttttctttaagtgattgatgatcccagagctggcaaaaaagaaaccaactaaaaagatactgaaccaaggtcccaaagcaatgatgatcgtcccacttaaggcagctgctaaagcaccggataaagacaaccactgcaaaataaaagcggatcctgctacaaatgcactacagatcagtcccagtaaaaattgatagaaaaagaccacagcttccacctcgcttttttcatcagtttagcataaagcaaacttgtatgtagctttttttcgttactgacagcattttgctcgtcaaatgagagcgtttcatttaagcttagactaagaggtgagtgtatgaaaatcgtgatcatcggcggttcattcggagggatcagctgcgccatcgaagcacgcaaaatctatccagaatctgaaatcgtattgattgaaaaaaaagcccatatcgggtttattcccagcgggatgctcctgtatttagaaggcaagattccttcgttgcaagacgcattcttttgctccaaggaacagcttgagcagttggacattcaagtagcattgcaagaaacaatgttgaaacttgatcctaagaaccatttcgttcaaacagatcagcgcagaatcgcttatgatcggttgatcttagcagcaggatctgcacaagaatcagaaattctcttaccgatgaatgaagccgcattgacctataaagattacggcgctgccaagcaatttattcaggaattagatcaggcagaaacgattacgatcgttggggctggacaagcaggtatggaagcagccaacacattaacgacgctaggaaaacaagtccaactagtggaatcaatgacgtatcctttattcaaatattttgatcaatcgtttctggctccttttttagatgaattagcacaaataaaaaatctgcagctttatctggcagaacctaccattgccattgaatccacggaaacaggcttccgagtggagaccgccaatcggacattgctcagcgcgcttgcattgacgaccgtcaatgtccgaccgcggccgcacccagcatttcagcagctgcgcttgcacagtgatcatacgatttggacggatgcttatttggaaacttccgaaaagggtatttttgctgtcggtgacttgattcagatctacagtccaattacacgggatacggcttatatgccattagtaaacaatgcagttcgttccggaatcgctgctgcgcataatttgcaagagaaaaaagaaccttttcgcggcggcttacggacagtgggaacccatctgtttggctggtatctggctagtacaggaatgactgaatcagatcgcttcttttatgaacaagaaattaccgtcaaaaaatttaccgctaaagcttcattagtagatgacacaccgatccacgggaaactgatcattgccaagacaagcgggcaagtattgggcgctcagttactgtcaaagtacaatctcttagaaaaaatcaacctgctggcatttgccattgaaaaggagagcacattgtcagagttagcgcaaaaagatttcttttttcatcctcattttactgatgtctttgaactgtccaatgcgattgctttaggaagtgctgcaaatgaaatttgaacaattattagaaaaaaaagaagccaagcaattacagctactgaaaaagctgcttctagttggaggtgaactagagcttcatgagatggctgcttaccttaggatcagcaaaccatccttagaaaaatatgttgatgagttatttctatatttagctccttattctgatcaatgccatcttttttatcaaggttcatcattagttctagaaacgagcccagagttctcgttgaatcagattgaatatgtgttctaccactcgtcgatcaaatttcaagtgctggaacatgtattgatcaatcaagaaatcgccacgattccgttagcgcaaaaattaatgattagtgaatcctccctgtttcgcaaaatcaaagaattgaatcaagtgttggcagaattcggattagagatttggcaggggaaactcatgggggaagaagctcagattcgctatttttattttcagctgctttggtacttaaattctttcaagagtcagccattaccgattgatacaaaatttgtgggactgatcgctcgtgggctcaatctgacctttaccgaggaagcacagcaacgggtcagtttgtggctgaagatcatgaagtatcgtttaaaagcgcccggacaatcgtttcaaagactacgggaaaacatggcattttatgagaaagatccattgtatcagcaactgcgggaacttgtctttcgcagttttgggcattatgcactggaagttcgtgaagaagaggcgatgctccattttgttttcttgctttccttttccgttttctctgaacaagattttcgccagtacatgctgcaacgctcccgatttacgccgacagcacttaccgatacgctgatcttggaacatatcctgcatttgtatcgaccggctgtcccgcaagaaatcgaagccaattgttattttcatctttctcagatccatagtcgtttgtattttttcaaaggagatgtcgaagtttttgatcgagaaaatatttggcaattagaagcaaaactctcaagtcgtaatattcgccagatcagtgaacgtttattgaatactgctgtacaagaaatgaagctggaagcatcagaagaaaatacattgtatatgatgaccatggtcaaatatttgagtgtcctgacgatcattgattaccaaatcaatcgggaatttcgggtaggcatcgcgttgaatatggatgcacttttcaaagaggcagtcttttatatgtggctgctgtacttaaaaaatttgaatggggtcgtcgttgagcgctatgctaaagaacaagactatgatctgatcttgacgaattatccgattgaaacatcgattcctacatatcggatcagtgagttagggacgacttacgatcgagaaaaaatcaaaaagatgattcgcgaacgcttcaactaatggcgtttttccagatttcgtcaatttcttagaaaatctctaaaaagttgacgagatcactacaggtaattcgagtaagataaatgtaagaaaacggtatcaaaagaataaatcaaccatttaaaaggagagagaaacatggcagagaaaaactatattatggcaatcgatcaaggaactacaagctcaagagcaattatttttgaccgcaacggacaaaatgtcggtagttcgcaaaaggaatttccccaatattttccaaaatctggttgggtagaacacaatgccaatgaaatctggaactctgttcaatcagttatcgcgggagcctttatcgaatctgggattcgacctgaagcaatcgccggaatcgggattaccaaccaacgggaaacaacagttgtttgggataaaaataccggtcaaccgatcgccaatgcgatcgtttggcaatcgcgccaatcttctccgattgctgaccaattgaaagccgacggacatacagacatgatccatgaaaagacagggttagtgatcgatgcttacttctctgctacgaaaatccgctggctgcttgataatgtggaaggtgcacaagaaaaagcagagaatggggatctactattcggtaccattgattcgtggcttgtctggaaactgacagatgggcaagtccatgtgacggattactccaatgcgagtcggaccatgctttataacatccatcgtttagaatgggatcaagaaattttggatttgttaaatattccagcatccatgttgccggaagtcaaaagcaactccgaagtttacggccatactcgcagctatcatttttatggcagtgaagtaccgattgctgggatggcaggggaccaacaggctgctctctttgggcaaatggcttttgaaaaaggcatgatcaaaaatacgtacggtacaggggcgtttatcgttatgaataccggagaggaaccacaattatccgacaatgatctgttgaccacgatcggctatggaatcaatggtaaagtatactacgcattggaaggtagtatttttgttgccggctcagcgatccaatggttgcgggatggcttacgtatgatcgagacgtctccgcaatctgaagaattagcggcaaaagcgactggcgacaatgaagtctatgtcgtaccagcctttacgggattaggtgcaccttattgggattctgatgctcggggagcagtttttggcttgacccgcgggacaacgaaagaagacttcgtgcgggcgaccttgcaggctgtcgcttatcaatcgaaggatgtcatcgataccatgaaaaaagattcagggatcgatatcccattgttgaaagtggatggcggggctgctaaaaatgatcttttgatgcaattccaagcagatatcttagatattgaagtacaacgggcagccaatcttgaaacgacagcactgggggcggcttatttagctggcttggccgtcggcttctggaaagacctcgacgaattgaaagcaatggcagaagatggtcaactctttacaccagaaatgccagctgatgaacgtgagaacctttatgaaggatggaaacaagcagtggcagcgactcagatgtttaaattcaaagtgaagaaagaaggcgagtaagccatgactttttcttataaagatcggcaacacgccctagcagaagcaaaaaatacgacctatgatgtattgatcattggtggcggaatcactggtgctggagtcgccgtgcaaacggcagctgccggcatgaaaacgattttggtagaaatgcaggattttgctgaaggaacctcctctcgttcgacgaaactggttcatgggggcatccgctatttgaaaacatttgatgtcgaagttgtggcagatacagtgagggaacgagcgatcgtgcaacagatcgctccccatattcctaaaccagatcccatgcttttacctatctacgatgagcccggtgcaaccttcaatcttttttctgtcaagattgccatggatttgtatgatcgtctggcaaatgtaacagatagtaaatatgccaattatacgttgacgaaagaagaagtattggaacgagaaccgcaactgcaacatgagaacttgaccggaggcggagtctatctggatttccgcaacaacgatgcccgtttagtgatcgaaaatatcaaacgggcccatcaagatggtgctgcaatgatcagcaaagccaaagttgtcggtatgcttcatgatgaacaaggaaaaatcaatggtgttcaagtagaagatcaattaacgaaagaacaattcgccatccatgcgaaagttgtgatcaataccactggaccatggtctgatatcgttcgagaattagatagcaatgataacttaccgccgcaaatgcgcccaaccaaaggtgtccatttagtggtggatcgtgaaaagctgaaagtacctcagccaacttattttgatactggcaagaatgatggtcggatggtttttgtggttcctagggagaacaagacgtattttggtacgacagatacggattacacgggcgatttttcccatccgactgttacgcaagaagacgtcgattatcttttagagatcatcaaccatcgctttccagaagctgcgatccaactggatgatattgaagctagctgggcggggttacgcccgctgatcacggctaatggcggttctgattacaacggcggagctaagagcaaactttcggatgaaagctttgatcaaatcgtgcaaactgtagaagcgtatttggacgatcaccgcaaacgcccgcaagtcgaaagggcgatcaaacaagcagaggaacgtctagaagccagcagtgtggatccttcacaagtttctcggggcagcagcttggaaatgtctcaagacggactgttgacactggccgggggcaagattacagattatcggttaatggctgaaggcgccgtcaaacgaatcaatgaattactggctgcaaaagggcagcagtttgaattagtggattccacgcgttatccggtgtctggcggcgaaattgatccgaccaatgtcgaggacgaactggcgcaattggcgaaaaccgccgaagctgccggtttttcccctgaagatgcacgatacttggccgatctttacggttcaaacttaccgatagtccttacctataaaaccacgtttgcggggctggacgaaaaagaaagcacggcattgaattatgccttgcaagaagaactggttctgacccctgtggattatttattgcgacgaaccaatcatgttctctttatgcgagatacgttggatcagatcaaagttggtgtgatcgatgcaatggcggattattttgaatggacagctgcagacaagcaaatgtatgccgaagaattggatcaagtaattgcggaatcagatttgagtgccttaaaaggaggagaatgatatgagtgatgcaacacaaatctttagtgaatttctgggaacggcaattttagttttactgggggatggtgtttgtgcggcagtcaaccttaaaaagagtaaagcagaagcttccggctggatcgtgatcgcgacaggctgggcaacagctgtgacgattgctgtttatgcctctggtttcatgggacctgcccatttgaaccctgctgtaacgttgggaatggcaatgacgggtaatttttcttggggattggcggtacctttcatgttagcacagttagcaggcgggatcgtcggtgcaattcttgtttggctcaattacttgccgttatgggatgaaacagaagatcaaggcgctattttagggacatttgccactggacctgccgttcgtaacttagccgcgaatacgatgaccgaagtgatcggtacgtttgttttagtatttggcttgttggcatttggtgcaaatacctttacggatggcttgaacccaatcgtagtcggaatcttgattttggcgatcggtctttctttaggcggaccgacaggatatgccatcaacccagctcgagatttaggtccgcggatcgcccatcaaattttgcccatcaaaaataaaggaacatctgactggggatatgcgtttgtaccaatcattggaccttttatcggtgcagcattggcagccggactattcatgattttaccgctctaattgactcattgatcttttaaacgatagcgatctgctagatggctatcgtttcttttttttgataaattccttcggttgattgaattcttccagcgaaagtggttaaataaagaagctgaaaaaagagcaaaggagcatgtatgtgaaaaaaattttgcgtgtttgtttatggcttgtcggtattctagtaacactagcactagtcgtactgattgcttttcaagtgtcgcctcgtccaggggcctatctgattggaaaaatgtttaatgacgaggtgaagatcacagatgaaaccgcgtatcaaaaaagtttgcctcatgtgacggtaaaaaatgatctgacctatacttctgactatgatcgtagtacatttgacctctatcatccccaaggtgcttcgaaagtaccagttgttttctgggtgcatggtggtggttacgtcggtggtgataaggaaggggccaaagaatttgcgacctacttagcagatcgcggacaagtggcagtggtttcattgaactatgagtgggctcctagtctagaatacccagggcaagtcaaacaaatcaatcaagcctatcaatcgatcaagaaagaggcagcgcaatatccaatgttagactttaaaaaagtcatttttggtggagactctgccggctcacagattgctgggcaattcttagcgatccaaaccaattcggattacgccaaagatatgaagatgacgcaagtgatcccatcaggagatataaaaggattcatttcttattgcggacctgttgacttgaagcaaatggctcatcaaacttctgatgatcgcttcatgaaattctttgttaaaacagtcgcgtggtctttattaggaaccaaagattggaaaaacagtaaggaattgcagcaagtgtcattagtcaataaattgaccaaagaatttccgccaacctatatcacggatggcaatgcctattctttccaggatcaaggaatcgcttttgatcagaagcttcaagagctagatgtgccagttaaatctctcttttacaaagatgttcctgaggcagtcaatcatgaataccaatttgattattcgctagaagaatcaaagaaatgtttggatgaaaccctcgacttccttaaaaatgtgatgctgtaaggcttcaaaacgcgaaaaaaagttgaccctaataaaaggtcaactttttttaatctcctagaccgatgaaatagtcatcatctttcattgcttctaccgttcctaatagatagccattccccacttgagagaagaaatcgtgattgctggttccggtagagataccattcattacgatcggattgacatcattggccgtatctggaaacaggggatcttggcctaagttcatcaatgctttgtttgcattgtagcgcaagaaggttttgacttcttccgtccagccgatcgcgtcatacaattcttcggtgtaccgttcttcattttcatacaattcatacaacaaatcgtacatccagtccttcaaacgctgttgttcttcttcaggaagctcattgaaacctaattggaatttgtagccgatatacgttccatgtaccgattcatcacgaataatcagtttaatgatctctgcaacgttagccaatttattattgcctaaataatagagcggtgtataaaaaccggaataaaaaagaaacgtttctagaaaaacactcgcaattttcttttcaaggggagtcccgttcttatagatctcattgatacgttctgcttttttttgcagatagggattcgtattggtccattcaaagatttcatcgatctcggcttttgtattcaatgtgctaaagatagaagaataacttttggcatggacagattccatgaattgaatattgttcaaaacagcttcttcatggggcgtgcgtacgtctttacgcagctgatccattccgctttctgattgaaccgtatcgagcagtgttagcccgccaaatacataaccaaccgttgttttttctagatctgaaagtgtccgccaatcatctaaatcattggataatggaatacgcgtatctagccagaattgttctgtcagcttttcccaagttgatttatcgatgatgtcttcaatcgcattccagttgattgcttcataataagttttgcccatcttaggttcctccaatagtagtcttgataccagagacaagaacaaaaggagcctacctgattgtcagtcgcaaatgccttcaacctttcgggaggatctctaatccatctcgatcatgctttggtgaagacatttgattcaatcaggtagtttttttgttcttagtcagtgcttagcttagcgtgcatgattaaatcacacagctttcgcattgattgctgccgatttcttctgcgtcatccgtaaaggtccgtacataataaatcgatttgatccctttatggaacgcataatgacgcagaatgttcaagtcacgggttgtctgtttactggtttctttccattcatagagcccttctggaatatctgagcgcatgaagagggtcatactcattccttgatccacgtgtttttgtgcagttgcataaacatcgataactttacgcatatccatatcataggctgagcgatagtaaccaatcgtatcattgctcaagtaaggtgcaggatagtaaatcttcccaattttcttttcttgccgttcttcgatcattcgtgtgattggatggatactcgcacttgtatcattgatataagagatagaaccatttggcgcaacggctaaacggttttggtggtacaagccgtcttttttgactgcttctgccaatgcggcccaatcttctccagaaggaataaagacaccgtcgaacaacgctttgattttgtctgattttggttggtaatcccctgtgatatagtctgtgaaatagctgccatccgcataagctgatttctcaaagttatggaacacttcgccccgttctttggcgatgttattgctttctacaagtgtccagtagttgagcaacataaagtataagtctgtgaattctaatgattcaggagaaccatattccatttgattcttcgcaaaataggtatgcaagcccattgcacctaaaccaatcgtatggttcaacgcatttccattttgaatagaaggaacaacgtcgatgtcagaagcatctgtaacaaaagtcaatgcgcgagtcatggcacggacggattttccaaaatcaggactgtccatcaaattgacgatgtttgttgaaccaagattgcaactaatgtcggtgccaagcacttcatattcttgtttgccgttgattacagaaggttcttgaacttgcaggatctctgaacaaaggttactcataatgattttgccatcgattgggttggaacgattggcggtatcaatattgatgatgtaaggatagccagattcttgctgcaatttcgaaatttcattttcaaggtcccgagctttgatttttgttttacgaatgttaggattcatgactaaattgtcgtattcttttgtgatgtcgatgtaagagaacggaataccgtattctttttcgacactgtatgggctgaataaatacatgtcttcatttttacgggtcaattcatagaatttatcaggaacgatcacaccaagagaaagagtcttgacccggattttttcatccgcattttcttttttggcagataggaaactgatgatgtctggatggaacacgttgagataaacgacaccagcaccttgccgctgcccgagttgattggagtagctaaagctatcttcgaacaatttcatgaccggcatcacaccactggcagcgccttcgtagcctttgattggcgcaccagcttcccgtaggttagacaacgtgattcccacgccgccgccgattcgagaaagttgcaatgcggaattgatcccccgaccgattgcgttcatatcgtcggtcaactggatcaggaaacaagaaaccaattcgcctcgacgtttgcggccagcattcaaaaaagaaggtgttgccggctgataacgctgatagatcatttcatcagccaaagccaaagctaattcttcatctccatctgcaaaatagagggcattgaatgctacacggtcctcatagctttccaaataggctgttccatcattagttttcaatgcatattgagaataaaatttgtacgctgccatgaaggacttgaaggtaaaatgctgttccgacagaaactgataaagttcttcgataaacgcaggacgatacttacgaatgaaagcttcttctaagtagtcatgttcaatcaagtaatcgattttgtcagtgactgaatcgaaagtcatcgtatttggctcaacattttctttgaaaaaagccgccagggcttctttatctttgtgtagagggatctgtccatcaacggggcggttgatttcattgttcaatttaaaatagcttacatctttgatttctttcaagctcataaaaagcaacctctttccttgttttgatcgtataaaaaaggatctgcaggtcttgacgactgacaaatcctccaaaaacacattggttaagttactgcttagctggccaattgacgtaattgatccggacggaagccaatgattgtttgtgcatcagaagtgatgatcggaacgctttggaatccttgttctttcaaaaactcaattgcttcaggctggttgtcaatattgatttcttcaaaagaaatatgattatcgcttaaaaagcgttttgccattttacattgcatacagttgttttttgaaaatagtttaatattcataatgatttcctccgagtcagtagtagttataaatctagtataaataagtcttggagaaagtcaacggaaaaacactatatctagtgcttgtgaaaattacatacacaatttatagtgtttagccagtttttatacagccaaaaaaagctgatttttcctagaaaatcgcgatttatagccaaaaagatccgagaatatgcaatggagttgagtaaaaaaagtttgaattgtgaacgaacattcaagatcctttttgaaacagattgactttagtcctaaatcgctctattataatgataatcattctcaattaagtagaaaactagtaaaaatcgttcacaagaggagggagaaatcatgaaaatggcgcaaacagaggcttctagagtctatcaaatcgaagcgatcacgacaccaaagaacgtcacggcgcatttaaatgatttgggtcttcgggtaggcgttgacattctcatggttcaaaaaaactgtaaaagcggcatcatcttgcatcgggacaaccggatcgcattggatgccagcgtcatggagcagattgacgtgtccgaaagacaacagcagacggttttgacttctctagatcaattacatgtaggagagcagggcaaggtggtaaaaattgcaacgactggtgctttgcggcggcgattgatggatatggggatcaccaagaatgtgccgattcatatcgtgaaactagcgccactaggtgatccgatcgagattcgcttaagagggtatgaattgtcgctgagaaaacaagaagcagctttcgtctttgttgaaaaaggagtagaggaatgacctatcaattcgcattagtcggcaatcccaatagcggcaaaactagcaccttcaaccaactgacgggggccaagcaaaccgttgggaactggccgggagtgacagtcgaacgaaaatcaggaaagctccgtaaagccaaagaaattaccatccaagatttgccgggtatctattcattgtctccttatactcctgaagaagtgatctcgagaaattatttggcagaagcccccatcgatgcggttttagatatcgttgatggcacgaacttggagcggaatctctacctcactttacaattgttggaaatgggtctgcctacaatagtgggaatcaatatgatcgatcttttaaagcgcaaagggatccagatcaactttgagaagctagcctatggcttaggcgtaccggttgtgggaatcagtgccttgaaacaacagggactgaataagctgatcgatgctgcaaagaaaagagcaggaaatggtcagtcaagcgtcatctacgattcacgtttagaggcggctttagcagagatcattggtctattgccaactgaaattcccgagagcaaacgacgctggattgctgtcaagctgtttgaaggtgacgaattgattcgtcaacaagtcgctttgactccgagcgatgaaaaagaattagcggaaatcattaaaatcacggaaatgatttttgatgagcaaagcgatgcaattatagtaaacgaacggtatggattcattcaacaattgttagctttagcaacagtcaaggaagaagagtaccgcttgtccttaagcgacaaaatcgaccgtgtgttgacccaccgcctactggcactaccgatttttgcccttttcatgtggggaatctacttcttatccatccaatcgatcggtacgatgggcaccgactgggtcaatgatgtcctgtttggcagcttagtcccggatattctgcagcagctgatgaaccaatggcaagtagcccaatggctgcaggaattgatccaagatgggatcgtggcgggtgtcggggctgtccttggatttgttccacaaatttttgtgctctttttctgcttggcgttattagaagattgcggctacatggcacgcatcgcttttgtgatggatcgcttgttccgcaagtttggtttgtcaggaaagtctttcattccgatgctgatcgctactggctgtggtgtacctggggtcatggccagccggactattgaaaatgaaaaagatcgccgtttgacggtcatggtcacgacatttatgccttgttctgcaaagctgccgatcattgcactgatttccggggcgttctttcccggcagttcatgggtcgcaccttctgcgtatttcattgggatgggggccattattttatcaggtatcgcattgaaaaagactgctctctttgccggcgacccagcacccttcatcatggagctgcctgcctatcatttgccgcaactaggaaccgtgttgaaaagtgcgattgatcgggccgtagccttcatcaaaaaagccggaacgatcatcttcgttgcatgtatctttatctggtttacttctagctacaactttacctttgatcgagtgggggaagaagaaagcatcttagcctttttcggccgtttgttagcaccgatttttgcgccactaggctggggcacttggcgaggtgccgtggcgaccattacaggattggtggcaaaagaaaatgtcatcgggacttttgggattttgtacggccaaagtggggtttctgaaaccggtacagagatctggcaagtgctgcgaggcgattacaccccagtagccgcctactcctttttgatttttaacttattgtgtgccccttgttttgcggccatcggcgcgatccatcgtgaaatgggggatagcaagtggacttggttggctattagttaccagtgtggactggcttattgtgcaagtctgattgtttaccaattcgggcatatcttctttgaaggagggcaactgacagtaggaaccttggcagcgttgattgttcttggtttgttgctgtttgctctgataaagagaccccaacaaaaaaattcaccactattacaagtagtcggagaagtagtaggaggcgaaaaatgattgcaacgattcttttaagtctagtgatctttggctatgcaggaaaagtgctttatcgaatggtcaaaaaaggcagttgttctgattgccatcaaagctgtccagtaaagcaagaagagaaaatctaaaaattatccatgaatctaacgccagttttattaggtaactagcgagtatgagtaaagcagttaggcagaaatgcctagctgctctttttatgagaaagggctatcaaaagaactgattctttagtatgattaattatatacatgatatataggtttgttttattaaagaaagtaagcagaaaaacagcatgaaacgaaatgtagataaagcaaatatcataaacagtaatgtaaacaagaacgagcgaacgttgataatgaaagttacattgggaaggcggagagcagcaatgaggcaacaacgaaggattgaacaacggaaaagacagcttctatgggcattgagcataagtttactgcttgttacgattgccgttagttattggctgattcacaccatgcgtactgggactgattcgtcaacaagctccccagataaccaagtgtcactttctacttccagccaagaaacaacaacggcctctcaatcgtcgaaaattactctgacagcaagtggcgatatgctctatcacagaccagtttatatgagtgcatttgatgggaaacgctatgattttgacaatgactttgagcaggtgcaaccgttgatcgcttctgccgatattgcttttggtgactttgaaggcaccatcaatcccaacaaagaactaggcggttatcctacctttaatgcgcctccgaatgtagtagaaagtatcaaagcagctggttttgatgtgattgatctagcccataatcatattttggatactggaatcgaagggcttaaaacgactgctaatgcttttcaggagattggattggagccgattggtgtcaatgtaaatgatcaagggatattcgtcaaagaagccaatggcatcaaagtagcgatgctggcttatgcttacggattcaatggcaatgaagctagcttggcaccggaagaatatacgacctatttaaaagatttatccatggaaaaagtagcagctgaaatcaaagaggcagagaatgtagccgacatcaccgttgttatgccgcaactcggtgtagaatattccttagaacctacagaagagcagcagaagatttatcgacaaatgatcgacctcggagcggacatcatttttggcggtcatccacatgtcgctgaaccaacagaaatcatcgaaaaagacggcgagaaaaaatttattctctattcaatgggaaatttgctatccaatcaacgctacgaaacagtcaacaactattggaccgagcgaggggtcattccagaagtcgagctcacaaaagaaggtgatcgtacatttttgagtgatatcaagctgcatccaacatgggtctctaaagagccgatccctgatcgtagatatgacgatccagagtttggcactaccgaagcctatgattttcaagttgtactggcagaagaatatcttcctggggggaagtatgcggataaagtacccgaagacaaacgccagcgaatcgaaaccgcgtatcatgaaatgatggagctgctaaatttaaaatggaaataagcagctgaatctgtctcactaacctatgacaggtatcaagcaggcatcttttgaggtaagatgtctgcttttttgctgttttatttagtagctcgatcatcttgcagcagatcttttaggagcatttagcccgctttttctagtaatgacacccacaagttgaacagaatgacaatcactgagagcagactagttgctgtaagttgataaaacagcaaaattcagcaaatttcattggctacagttcagtttttcaagcttttttctagaagagatgaacgcaatcactattgccggtaccagtgatattgcttatagtaaacgcatacaagaagactcgagaattctttgtacgagaggtggttaactttgttaagcgaattattaaaagaagactatatccaattggatatctcagtagaaaattttgacgaagcaatcaaggcatccgcacagccgctattgactgccggtgtcatcgaaaagaaatacatttcatccatcctttctatttatcatgagatagggccttatattgttattacgaaacaaattgcgctgcctcatgcacccatagagaagggggcaaagaaattagcattaggcttcactcgattaaaacgacccgtcatttctggtcatgaatcaaatgatcctgtcaaatttttgtttccccttagcgcaccagacaatgaatcccatatttcattgttatccgaactggctgagttgctgggcaacaaagactttctggaattgttaggacgaatgactgaaaaaaacgaactaattgcatttctaaaaaaatttgaaggagagaataactatgcataaagcactgattgcctgtcgagcaggcgtaggctcaagtctgatgttaaaaatcaaagtgaatgaggtcatccgggaaaatgactttccaatcgaggtggaacatgcgtctttagatgcggtctctggttttacgggagatctgatcattactttgacagatgttgccaatgaattaagagaaaaaaatttgcagcaaactatcattggaatcaacaatatcgttgataagaaagaaatcaaagaaaaaattgcagccgcattagtctaaaaatcaatgaaggagaaacgctcatggatttaattattagttttcttagtacgccagccgtacttttaggtttagttgcaatgattgggttattggcccaaaaaaaatcaatgaccgaagtgttgactggaacctttaaaaccatcatcggtttcttagtattcagttccggcggttcgatcatgactggcgcactacagaatttcaataccttattccaaaaagggttcaacatcgtaggggtcgttgcatcaccagaagctgccactgcactagcccaaacagaatttgcatttgtgaccagttgtacattgattctcggctttttgatgaacttagtcattgctcgaatcacgccatttaaaaatattttctttaccacaggacatagtttgtttttcgcttgtgtgttgtcactgatcctaaaggctcatcagtttgctgatattccagcgatattaattggcggaacattactcggctttttctctgctgcgttacctcagctgtgccaaccatttatgcggcgcattactggcagtgatgagaccgccattggacactttaacatggtgggttatgcattgtctggttacattgggatgctatttggtaaacacaaagataaaacaacggaacacatcaattttccgaaatggttatccttttttagagacttcttgatgggcgttgcggcagttatgctagtgctattctatatctctgcattaaaagcggggcgagacgtcactcaagaattagcaggaacgactcattggctggtctttcctttcgtgcaggcatttacctttactgcgggaatgtcgatcttgatgactggtgtgcgcatgttcttgtctgaaattacggcggcatttgtttcaatctcggaaaaattcattccaaattctcgtccggcattggatgtaccaactgttttcccatttgcaccaacggctgtcattgtagggttcttatcctcttatgtcgctggcttattgggagtattgatcatggtgcttttcaattttccagtcgtgatcattccagcagcccatatttgtttcttctctggaggaacagccggcgtttttggaaactctactggcggttggcggggagcgattgcaggatcctttgtcatcgggctgttactcgcctttttaccaacagttctttacccggtgtatggtagcttaggcatcgagggatcgacattcccaaatatcgactacaatgtcatgggaattttattagataaactattaagtttgtttggtcagtaatcgatcgctaagatatttgtcatcaactgaacttctgaatctttgcacgcaaaaagaactatctcaaagtgtgcaaagattcagtgaaaacggatcagtgacagaaaggattttatatggaaacaacgaatttggcttattttttgcaaacaaccaaagatgagcttacagcttatttgaatgagatcaatcaacaacagttgatcgatgcagctgaactgatcgttgctgcaaaaaaaaagaaggggcgtgtgcatgtgactggcatcggtaagccaagtcatgttgcggaatatatagcagctttgctttcttccacaggcactcctacctattttttagatggaactgaaacgatccacggctctgccggccaagccgaaaaaggggatgtcgtgattgctatttccaatagcggcgaaacagaagaattgaaaaaatcgcttcttacgctcaaagctttaggaataaaagtcatcggagtgagtggaggtatcgactcatggctgcaaaaacattccgatgccttcttgtttgctggtatcacgaatgaaggagatccgttgaacaaacccccacgaatctcgatattggcagaaatcatcgttttacaaagcttgtcgattttactgcaacaagaagccgccattgatattgatgattattatgcatggcatcctggaggaagcttagggagtgctatcatgcaagaaagaagtgtcgaagaatgaagatcgaaggaatcattacagccatggtcagtcctttagatgagcagggaatcgatcgagcagccactagaagactagttaatcaattgattgcgaaagggatccatgggttatttatcctagggaccaatggggagttttatgccttatctcatgctgaaaagctcgaattggcaaccatcgttgtagaggagacagcaggtcgggtaccagtatttgcaggagcaggtgggatttcgacagaagctgtcattgatttagtgaatgaatttcaaaccattggagtcacagcggcttccatcatcactccttatttgatcaagcttacggatcaagaagtagtccaacactataaaatgattgctgcaaagacaaaactcccattgattctctacaatattcctaagaataccggcattgcgatcaatgaaaccatctttaacgcattgctgaaaatacccactattattgggatcaaagacagcagcggggacatagaaaacctcaaaagctatctcaaattgaatgagcgagacgatttttctattttagtaggttctgactctttgatcttggaagcgttggaatgtggcgctgatggggcagtcgcagcaacttccaatgtcttaacgacaactgacttagctatttatcacgcatttaaaagtggtgagacccagaaagctagaaactatcaattaagtattgaagactttcgccgtatcttaaagttcggtacagtacccagtgtcctaaaatactgcgtaggttggatgggaattcctgtcggtgatcctaagctgccggtgctgccagtagatgaacaggactatccagagatccatcaagttttagcggaatatcgaaaagtggagggattcgatgaataagaagctcgtgatcctcaaccggatccataaagaaaaaatcatggcgatcgtacgggtcgaaacagtggaacgagccgttgaaattgttgaaggctgtaaagccggtggtataacttgcttggaaatcagttatacgaataacaatgccggggaaatcatcaagcaactgaaagaaatctatcaagacgaaatcgttgtcggtgctggaaccgtattggatagcgaaaccgctcgggatgcgattttacatggtgctgaattcatcatctcaccggctttttcaaaagcagtcgcacagataagcaatcgctatcaaatcagctacatgccaggctgtacttctatctctgaggttttagaagctctcgaagcaggagcggatatgatcaaagcatttccaacgtcttctttacatgggccaaggatcgtctcaacaatcaaaacaccattgccgtttgtcccgatcttatcttcagggggcgtttctttgacaaatgttacagaatggttgaatgctggtgtagaatgtatgggagtaggaacattattgacaaaaggttcgcaagcagaaattgcaaagaatgcggcacgattgcgcaaagaaatcgacacatttgtgaattaacaaagagaggagagagggtcatgatcgatcaacgcacattacagctgatacagaaaatgattcaaaaaccattgatggaacaagaggagataatgcgcttcttttctctgtcaaaaaatcaattggattatgcaatcagaaaaatcaatgaactattaaaagcaaataaacagccgttgattcgatcagatccttattttattcaattagcaccaaaggcaaaagctttttttctgaatgatttcctaaacggtgccgtttatacccagtatgagatgaatagtgaagaacgaaaaaaatatatttttctgatgttgttttattatgaatcagactatctttctgtgaatcacttcttgtctgcgctgcgtgttggcaagactacctttatggcggatatgaaaaaattagaaaaagaactgtctctgtcaatgatcactattgggtatacgcggaagaacggctatgggctgattgggaatgaagaaaatctgcgtaatttttttatgaagatgatgtttcatgattttggggataatcaggaggagtttgtctatcattatttcttggtcaatgaaaaaattgatggcttctcacaggtcgagggtatcgcaagagaaaaactaaaaaccttttctttagaattagtggagaatcgcttgaatgaattctcttatttgtttacgatgatccttcctcgtttaaacaaacagtggcaagatttttatgaaacctataattaccagactttttttcagatgaaagagtatttatttgcaaaagaattattaatggaatttggtatcacaaataaatcagcccaattgtatgtctgtgggtggctgctggggatggcgctaggggataccacttatccatcagcggatttttcgattattcatgaactggtcgagcgcatcatcaaacgctttgaactattgtccggcatccgttttaaagataagcaaaaagtcatcaatcaattatatagtcactttcgaccagcttattaccgcttgtttttttcaattgccaattatcaatcccttacataaaaaaattattgaagaatatgaagatctgtatcagattgttcaagaaacattgcgtcccatcggaaatctttttgaacgcggaatcccagaagatgaagtttcttttttaaccatccactttgcttctttgatcaatgattttgatgaataccaagtcaatcaaaaaattggtgtgattgtttgtccgaatggaatcggtagctctgccatgatctataatgaattaaaaatgatctttccagacattatttttatcggacccattgagaccaaagaactattgcttgagcgccctgaatgtgacctgatctttactacggtacccaatgtcagtctttatacactgaaaaagccagtttatgtggtaaatccaataatgaccaatgaagaaagaaatcaattgattcaagaagtttaccatcagcccagcgaagctatttctctgattggggtggaagaacttatggctgttatcaaaaagcatgcgacaatcgaagatgataaaagtttgaagaaagaattgcaattgctccttaccagaagagaagtcaatccagcttattcagcaaccctaggcgaggaaagaaagcccgttgcgttgattgatatgcttaacccacagtacattttgactaatataaaagtacgctcttgggaagaggcattctatttggcagcaacgccactgatcaaggatcaagtgatctcacgtggttatattgatacgatcatccaaaacgttcgcaaagaaggaccttttttcattatcatggatcaagtagcattgcctcacgcacggccagaagaaggcgcgttaaagctaggcctaggcatcacagtcttacaagaaccagtgataatcaacaaaaaagcgtcgattaaatacatcttcaccctctcagcaattgatcacagcaaacatctatctgccattgccgagctcgtcgctttgttggaacaggaaagttttttcaacttactcgaacaagaagccgatcctcaacaaatctttgactggatcgcatcttttctcttgaaaaataagcatatggttccgatgtaattggactgaataactacaccagagtgatcacccccaaaaaatctaacttattgggttgcttcaataatcagtgttgtttgtgactctttccactacaactgacacacgaagatgtagataagataataccactgaacagtcaaagagcatttaggttacttgatgagagatcatgcaataaatcgatcgtgcttttaatcagacgtatacgcttgaggtaggttatttacatctaataaggacatgggaatcctatccttattgaatgaggcactatttaagttattccgctgaatcatgcagtaaacccgcttataacatccagaaggatcatttttaataattaaattaacatttttcatataaaaagagcaagagcaatcattgcgtattattgattgcacttgctttttttagattcaatccttttttattcataatgaaggtcgatatgaatttgggacagcctttaccgtcaagttatactatcaaaagattagactgaggaggggtgtggtggaaaacaacaatttaagaaaaaaaattagacgatttgtcatgatagcagttttggcgctattgactattggtctcttccaaaaagaagtttttgcagaaaacgtcaatacgttctcaatccaaccactagatgagaatggaaatgtgaatgagaatggctattaccatatcattgacgagccaggaaagcaacgcactgtttcaattcgagtgtataacctttctgaagaagaaatcagcgtgaatgtgaccgtaaatccagcttctacgaatcaaaatggaatccccagttatttaggggaagaagcgtatgatgcttctctcattcatcgaatggatcaactggtcgcaattgaagagagtgaactcctgattcctgcaggttcttcggtactcacaacactgattatctccttaccacaagaagaatgggaaggggatatccttggaggcattcgttttactgaaaaaaagaatcagcagagtgaacaaactgtgactcatgaagtcgcctatacggtaggcattcttttaaatcgagtaggcgggtcagcagttgaaaatgaattgtttttaaatgaggtgaccgcgagtcagcgtaattatcggaatcacattgaagcaaatctacaaaatagagctgctgtgattgttcgcaacatgtctattcagtcaagcatttatagagaaggaagtggaacccctatctatacatatgacgcatacgagttgcgaatggcaccaaattctaatttcaactttggcatccctgctggaaatcagccaattgaagcagggaattatgttctaaagacgcaagtaacagctgatgaaaaagagtatcgctttgaacaatctttttccattacgaatgcgaatgcccggcaattaaatcaaagtgcggtcaatctagagcggacgacatcctacatgtcatatgggatatttgtcggaattggcgtgatcctcgttcttttggtgatgtggtggacttgaaggcggactcggagaaaaaagagaagaaaacgacccatgatataaaaaggactggcttatcggagtcatccagcaaattaaagagcataaaatgcttaatcgtaatgaaatgaatgagcaggatcttgtgaaactatgaaggaacaccctgtaaaatgaacttcaaaaggataacggaggaaagaaaatgaaaaaaacgacacgaacattatcaattgtacttttagcagctagtcttggattggatagcaaaatgggggatgcggcaacttatgatgacgcagcgaatattacgactgaaggaaaagtgaaaatcttggaaaatgactcttcaaacccagtcgttcctgacccggagaatccaggaaatgaggttactcccgaagaaccaaccaatccttatccgggacttttacggatcaactatgtatcaaactttgattttggtcagattcaaaatgtctcgcgtgcgattgaacaaaaagcgcggctcgatcatgtgtgggtaaacggtgaagaagtctcgcgtgtgccttttgtcgcgacagaagatcgccgaggaagtgaacggctaggatgggaattacaagtatcacagccgaatcaattggcagatgcgagtggtcatgaattgattggggcaacgattactttatccgggctgcgttatgtgaatgcaacggctgctacaccaatagtcaatcaaaatgagatcgtcctcggagcagcggcacaaacgctagccacagcagataccgcgcaagggtcaggtgcttgggcattagcattaggacaatcaaatggagaagggcatactgacggtgttgtattgcgtataccagccaataccacagcaaacaatactgaatattctactgcgattgtttgggagctggttgcggatccgactacaggaataggtggataaatcaccctaaattcttctggattaatttgaagggaaaggcgcgatcaaatgaaaagaaatgtccttatcaccatagcaagtttactcgttacagggcacttgcttccctcgacaatcctatttgcggaaaccgttgatgcgtcagagagacaaagggcagaagaccaaagttccactcttgattcagatgaacatcaattttttgaacctgtagatgcagaagatcatgcggctgatgaatcagagggaaacttagatttgcttgattcagggttggatgaagagaacattgatcctgaattaagcgcgattccagaaagaacggaagagtctaaaacgattcaaccaagtgaacatagcggttattctgacgaaactgtgctcacagccgaagcagtccctcaaaagataggactaggtgggaaatttgtcgaggaacgactgaatgagttagtgacaaacgtcaggctgaatggagatgaagtcgcaggtgaggactttaaagtcactcttttgaatcaaccgaacaccactttcctgggaaatctgcaagtcccaatcaccgtcgtacatgtagaaacacaagcagcgactcagataaatgtaccggtggaagtgatatggggccactcgatattttcacgagaagcagcaatcagtgctagcactggagtaatcagtcttcatatcaatgataacggaccatctcttgttgcatcagaaggatttggcaattcttggccgaatcaagttacatcaagaccacgttatacgatttatcgcaacgattacaccaaccaaacgctgcttcctttttttacagtaaaccaatcaagaagcagtgtcgtacaagcttggaacaatgtgttaaacaatagtccgattgactttggtgatgtgatcggattaagcgtaaataggttcgcagtagccaatcagaattacaatggagccaatacatgggtcacgagaaatgaagaacctgttcgagaggcgattggctggccagaggctctgtatatgatgacaccaagcggcttccaattgttgcgagtgaatcaattaacgacgaataaattaacttttgcagctagtagttcaacagaagaaatccttcagagaatgacagaatttttcaatttccatgaagaacttacggaacaggaaaaagaagagctttcgtttgatttgatccgttctgatgcactattaccaggcaaagaaggcaaagcagttgtacaagtgacacaaacaaaagaaaatgggtaccgtttttcaatgacgtacgaggtatcctttacagttggacttggacgactggagttggcgggaattgctcatggcaattttgattttggcgacgtcctaaaaacgagccgtagacaaaatattccagcgcaaggagagtctgctccaacgattatggtcagtgattacagtgatactgcccagtggagcctttatgcgtcgatgagcccttttataaatgaaagaaatcaggagttaagagaagcagccatcgctttgaaggagttgaaagtgatcgaatctgttcatacaggtatttccattcccaaaaatgatatcctgttgggaaccacccctcaaatgattgcggcaagagatagatcaggaacaagagatgaatacggaagaacaatcattcaaattggagaagtaaaagaccagacattaaccggtgtgtcacttcatttgcctgccaatacacctgtggacaagggagagtatcaagcaacaattacttgggaactagtcggggatccgacgataggaggcattcgatgagaaagagagtggtcgtgtttttggtcggtctctgcatttttatccccgtcttttcaaggagcacagtgattggacatgcgacaacaaatgagaatcgtgcggttgtgagcttttaccaagaggaagaacccacccaaccagacctggatgatccaagaacactcccacaaactggaagtaccttttcttatataggaatgctaggcttagtcattgtctttgtgatgtggtaaaaaaacagagaaaaaaaacgtagaaggacaaattgaagatttcacagcgtgtttgtaaaagagggacatctttcgaggcaaagaacagcaaaaaaaattggttataccatcggcaggttcttcatcaataaggaatgacgtgtcgtatagcaaaaaacctgagatagaatgatcatcattctatctcaggtttttttgtatcattttaattgattgatttaattgattgaagaataaataagaatcgaacaatttttaacaagagtaattctttcatttgctaaaaggaccttactggccatttaatgtacttacgattgataggaatatctgtattagccacaaagcagaagctttttaagcgaaagaatatcttttaaaagagggcataagaggttccaccttcgaacttgatttgcttaaaatccatcctaagatgagcgttcactgggctcgaatctacggctcactgattaagagtgtgattgtttagtcgtttcattggggtaatagctgaaaggaagagatttagtagatgcaacctgtttgttaaaagtattcctttttgtaaagctcggaataatttcataataaaacagaggagcgccgattttatttttttaaaaggttgcaacttttcataaaataactaagaaaagaagtggaatgagctccgctatactgtttatagcaatgcgaataaacgaaagaaaggatgaaaaaaatgaagatcagtaaagcagtattaaaggcaattacgttgagtagtgtgctggtattaggtggtacatacgcttctgcggctgagcaaaatcaggcaaacccttctgaagcaacgacaccgttacaaggaaacctaggtttatcagaaaatggtgggtacgatcccaatccgccgagtgatttaaatgaaaaaacaggaatcaaaaatagctattttggtatttcttatgtgcctagaacctttgattttgggatcaccaaattgcaagatagcataaaagagcaaacaatcactacgacgaataaaaatggaaaaacatttaacgttggagtgaaagacaagcgacgggaagatacacaaacatggtcattgaatgtgagacactcgattaatgtcgataatggctatcaaggggtggagctaaaggttcctctggtaggtgacgttaaaagaaatatgaatgatggggatactccttttgaagcagacgatttaactgaacaagtcaaaaaaaataaccaaaatgaagtaaataaatctgaaaatgagcatctaatggtcacatcagaggatcagacgatcatgtatacgaatggcggacaatttgtcaatggagtctatgatttacagttaggcgatgtcggtttacaaattcctgatccaagtagagtgccagatcaaacatttaaaggaaatgtgacttggacattgaccaacacgccaatgaaacaacattatttaacgaaagaaattcgtaatttatttaaagatggcaactgcactaccttaaaaacagatatacgctgtcaagatgttgaagcagcataaaatcttccagagtatgtctcgtaaagggaattgtttagataactcacctatggaaaacttctttggtttattaaagcaagagatttttcacggagaagtctatcggagtttagatgaattgaaaacaaaaattgaccaatatatctattattacaaccataaacgcatcaaaaagaaattaaattggcgaagtccggttcagtttcgagaagctgtaaaaacagctgtctaacagttaatcttatcatacaaaaaaggagtggatttctccactccataaaagtctaactttttggggtcactacactctgcaaatgagaaggggcttttttattttctgtatttattttctaatgctaaagcttttgctgtgaagttggtaaagtaattatctataccaagattgattgccttttttatttcactagtggagtttattgtccaaatattcaaaagttttttgtggccatgaactaatttaacattttcttttgtcatcatactcttttcagcagaaactatatctactatgtcatacgtgactgccttttctaattcgctttgattcttaactaataagagttttggcatatttggaaaacttttgctcaagtcttgcaacggtttaatatcagatgcttgaactacgatattatcttccaagttattttttttacaagatcttcgaaaagcttcgtttgattggagttttcctttagttctattacataattcacagtattcccgtatcgattaaacacatcttgcaaactcaatatcttttcattatcttcagttcttaaatcagaaatttcatcatcggtcatatctacaaaaagtttgtctacaccagttattctttttgctgataaatcatgagaaacataaagagtgttgtctctggatgtcacaagatcttgttcgatatattttgatccgtataaaatagccagatcataagcagcgactgtgtgttcaatctcttctccagaggctcctctatgggagtatacccttgaactggaatcgttagtgttttttattaagtaaaatgttattactgaagaaagaattactaaaaatattaagaatggaattagtatttttgttttttttatctttttacgatgcatacggtacctcaaggtttttcttttattgtaccagaaaaaaaatatataaaggaacagtttttctaactggggatcctaaggcataaataaatgtgcaaataaattaatcatttatcgacgaataccgacaactaggaactaaagatgataaaaatcaacaatatgacgtattcaaattagtcatattgttgatttttaatgttaattgaacagcaacaacaagaatccatggtaaacaaatagcccgctgcggagagcttataaacgaaatattaaacgttattcttttcatttgaattaaaaattattttattgtagactttgtaaggcgatattaaatcgtcaatgaagaggattaggcgggggaaacttggggaagtgtgcctaatcctcttcattttaagtgtacctaattttccaataagaagcattactttttggtaagatgtacatatgacttttatgttttttaaacatatgcaatttaatattaacctttagtattgaattactcaagggccaggtatagaatgtaagtaccaaccaattttttaatttccaaatcttctttataagttcccactctctctcggggagggtgggtcgttttttttgcacaaaaaagcacagcgtatttacacacactgcgcaagtgaaactatgtttctacatcgtaatcattatagcgtatttaacgtcctatttaaagactcaaactcaatcataatcttcgtcttgccaatcaccgaatacttcttaacaacaaattgcttccgatcgttaaactcaccagcaaccacaacctgcattccctcatccacatctgccaagaagtttaaactatgtgctgcaatcaaacaattcgtaccgtcaagagagaaacgcactaaaggggtcctcgacattttcaacactcgtatcttcgaaactacacctctcaatgatttcatgataactacttcttacttctaatttttagtggagattcaattatcatacgatcataaaatttgccattttttataaagcgttcacgttttacagcaatagatttatcgctttgagctaatacagcaagaatggataaatctaagaaaatcttatcatcgtcagaaagggtagagtattcgttagcaagttttgcatcaatttgttctgcaatcatatcttcaaacatttaaaatcactcctcgcaagaattatacgaacctatgttctatttgtaaacaaaaaaaggcgaaactcctcaaaaataagttccgcacagaattgttataaaataaaagaagataaatttatatacccacaaagtatacccacagcataaaaaaagccacatcaaggtttcttttctaaactaccgaagtagccaagaaaccttatgtggcgtgggtttggcacccaatgggccgtgaggggctcgaacccgcgacccgctgattaagagtcagctgctctaccaactgagctaacggcccgtatcaaaattactttattatcttagcactccgacttttaaaaatcaatcgttctgttaaaaaaaaatccgtttttttatctttcgtttcaaaagaagactacccatagagtacatactccgtaatacttatccccttcaaaaatcaaattcttttgttttcctaaattttgagcagaggactacaatccaataccagtatatggtaaaatttatctagttatcaaaaccagataaaaagtttttgataaaccaatattctgctatttaagatggagaagattatggaaaaattacgttcagatttatttgattggagcgagtcgctgaattcctttcatttgccgcggtgggaagagctgccaactttggaactgtacatggatcaagtcattacgttgatcgatcagtacttgtcgccggtaatccagtcggaaaaacattcactgctgacatcatcaatggtcaataattacgtcaaaaaagggatgatcccacccccagagaaaaaacggtataaccaaaaacatttggcatttttgattgccattacgatgttgaagcaagtgttgacaatcccagaaatcaagacgggaatattgtttcaaggaaaagtagtcgggatacgaaatgcgtacaatttattttgtgaagaacaggaaaaagccatttggacagtctgccaagaggcagcagggtcaaaagaagcggtgtctaccgatccgattccagtagaactgatcgcgatcaaaggggcgacccgttcgtttgcaaataaattattggcagaaaaaacgattgaactagaagtaaattacttggaaacgcacaaaggagaatcccatgaataaagagaaaattgccctgcttgtcgactcgggaaccgatgtcccggcagaaatcatgtcacaatatggtatgtatatgttgccattgcagatcatatacaaggatcggacgtatacggataaagtggatattacagcggaagagatctatcaacgattgccgcaagaaattcctagtacgtcattgcccgatggtgaaaccatcaacaagatatttgatcggatcaaagccgatggctatgaacaagttctggcagtcaccatctctagtgggttgagcggtacttataatgttgttcgcttgatgggagaacaacggaatgacttggatatttttgttttagatacgaaaaatatcgggattggtgctggattacaagcgatcagagctgctgagttgctgaatgagggagtcacatggcaagagctcaaagaacagctgctacaagaagttgtccgaaataaggtctttttcaatgtagcgacattggagtacttgcaaaaaggcggccgaattggtttggttgcttcaattctcggaaatgccttgaaattgaatccaatcatttcttgtaatgacgaagggatttattacacagtagcgaaatcacgaggacgtaaaaagagtttggacaagaccgttgaactggtgaaacagtacattggaaatcacaaacaatttcgcctagccgtggcccagggggatgcgttggcagaagctaaagaaatgaaaactcgtcttgaacaagaatttcctcaagtgaaagaaattttctttggacagatttcaccggcattggttgtgcatacagggcctggattattaggcgtcggagtgcagctgttagacgaaacggggatttgatcgagtgactgtgatcgttttctaagagccgctcacaatcattcattaatgaatgttaaaaggtatgaaagttgtcttttcaactttcatacctttttttgtgccgatgagtgaaaagaaacctgtttctctagagatgccgcaatggtcagtgacatgaagggttggcgctcttttgctctcttttgctcctatttactcctaagttattttcgttgaacaaaacaagcagtataatgatttcatagaacaaagcaacagttctccaaggagacggatgcttacagatggagctttatgctatccggattacttaaggcagtatcttgagttgtttatgaaaaaggagtgagtgacaatgaaagaatatgtttttgaatcaaccatttattcttctgagattggtaaaggtggagcatacgtgatttttccttacgatttgcgggctgaatggaataaagggcggctgaaagttcaggcaacatttgatggcgttgactatcaaggaagtatcgtcaatatggagttgaaaaatcaagacggaagtatttgttatattttaggaatcaagaaagagattcgcaaacagatcaaaaaagacattggcgatactgtaaaagttgttgtgaaacctattacggaatgaataagttagcaatcatgagtatgaaaaagaaagaacatcgatacaaaattttcttaagaataagcatagatcaaggctaagatttgaggaaagatgaaaacacatcctaaatcatgtataataagtaggaaagaataaaaaatgaggtgacattttttgaaaaagatcctagtcgtggacgatgaaaaaccgatctcggacatcgtcaaattcaatttgacaaaagaaggctacgaagtatatacagcttatgatggtgaagaagcattagaaaaagtggcagaagttgaaccggatctgattttattagatttgatgctgccgaaaatggatggattagaagtggcacgtgaagttcgaaaaaatcacgatatgccgattattatggttaccgccaaagattctgagatcgacaaagtgttaggactggaattgggtgccgatgattacgtgactaagcccttctccaaccgtgaattagtagctcgtgtcaaagctaatttacgtcgcggttctgcttcggcgaaagaagcagaagaagcaccgaatgcagaattgacgatcggtgatttgacgatccatccagatgcgtacatggtaactaaaaatggcgaagcaatcgaattgacccatcgtgaatttgaactaatgcactatctagcgaaacacttaggtcaagtcatgacacgggaacatttgctgcaaaccgtctggggatatgattattttggtgatgtgcggaccgtcgacgttaccgttcgccgtttacgggaaaaaatcgaagatagcccaagtcatccgaattatttggtcactcgtcgcggagtcggctattacttgcggaaccctgaacaggaataagctatgaaaaataaggttcgcttttttcgatcagtgaacttcaaaatcgccctgacttttatcttgatcttattgatttcgatccagattatcggggcgtattttattcgcgaattagagaaaacaacgatcgatgcctttaagcgcgacatggaggcaagagctagcacgttggtcgttactctaggttcagaacttagtcgaatggacgccgaagacagcctcgattgggatgcaatgaattcttctttgaaccggatcctttccagtaccaactcttctgagattttagagatgcgggtcgtagatgaacaaggaatcattcgggcaaccaccaatatcaatgatcgaggttcagtgggtgaaaaaaacgattaccgagattatgatacgaaccgtagtgaagtgttgtatgacgaatcgacaggacagcgggtctacaacattgtccaatcgatccagtcgcctacaggggatacggttttaggtacattgtacctgcgaagcaatctggaacagaaatacagtgaagtcagtgatactgccgtgatttttgtgacggcttctttaattgctgcagcgatctcaattgttgttgccctacttgtttctcgatccatcactcagccgattggggaaatgcgggaacaagccattcggattgccaaaggggattatagccgcaaagtagcagttcatggccaagacgaactgggacagctggctgaaacattcaatcagctaggagaacgtatcgaagaaacacaagaagcaatggagtcggaacgaaatcgactagatagtgtcctctcccacatgaccgatggcgtcgtagcgactgaccgccgtgggaaagtcattacaatcaatgagatggcgatgtcgttattgaatgttacttctgaagaagcagtcggtcaatcgattctgactctgctccaaatcgatgaagaatacaccttgcgtaaactgctagaaagtcctgatgaaatgctgatcgaacggccgaacaatgacatcgttggaacgaatttgattttacgaatcgacttttcaatgattcgccgtgagtctggatttatttctggtttagtagcggtgatgcatgatgttacagaacaagagaaaaatgaacaagagcggcgagagtttgtatccaatgtgtctcacgaattgcgaacacctttgaccagtatgcgcagctatattgaagcgttgagcgaaggggcttggcaagatccagaaatcgcaccgaacttcttgaaagtgacattagatgaaacggatcggatgattcgaatgatcaatgacctactgagtctttcacgaatggacagcggcaatgcgcaactgcaattggaatacatcaatttcaatgagttagtcagctttgtgttggatcgatttgatatgatggtgacgaatgagaacaaaaaatatgtgattcgtcgtgaattcaccaaacgtgaactttgggtcgaagtcgatacggataagatgattcaagtgatcgacaatattatgaacaatgctatcaaatattcacctgatggcggtgtgatcacagtcaaattgatggaaacccataacaatatcgttttgagtatcaatgatcaaggcctaggcatccctaaaaaggatcttaccaaaatctttgaccgcttttaccgtgttgataaagcccgcgcccggcaacaaggtggtactggtttaggattagccatttcccgcgaagtgatcaaatctcatgggggagccatttgggcagaaagccgagaaaaccgcggttcaacattttatatcatgttgccatatgaaccgtatgaggaggattggtgggaatgaaagtctcagaaaaaatgattcgtttaggtctgatcgttatggttgccctaagcttttacttttcctacatgatttggctgaatcccaccggttacgatcgttcagtcgaacaagctacagatacagtcaatacgagtattcagacctacaaacaaaaaagtgatttatttttgccattgtatttaacctggatccaccaagatgaagtcaaggaaaccaattctgaaacgttgattcgtgacgttcagggactgctctcggatgctcaagtcaatgatctgacggtacaaaattatgattccaagtctttttcagaggcagcaacattggatgagggagtgacgttggcgtattacacgccgttcttactaaatgattacgcggagacctttgatgttgaattggcattaggtgacaacgaagccaacaaaatggctttctcccatattcaaatcgatttgaaagagaataaaatccagtttgtgaatttggaagaatcacggatcattgaaggcaagattgactgggataaaaatgatgtgaatcgcattttgaaagataatccaagagaatggacagcgatgcgccaggaagaatcaggaaaaagcaatcagttctatacacaggacacgatcaagctgaaaaaatacagctatgtttcctctttgcaatcggcgaatctctttcgagaagcattttttacttcgccaaaagatgtcaaagtcaatgatgatagtgtagatacttattattatgaaggtggacagaatatggcggttttgcatgatgatcaagtagtcaaatttgaaaccactgtttcagaaagtgatgaaacggatctgtttatgcaaagtgcggactatattcgtcgtttgggcaacaatttcggaacgatacgcttttttgatcggttgagcaatcaactagattatcgtatttttgtagaagggtatccagtcttcagcagtggtgctcagggattgatgaaagtaactttttctaacagtgggcaattagggaatcgagagatggcaatcgaatctagtttaaatgcgatccaagtgccgattccttctgagaccgaggtggagctgccttcaagcttaaccgttcgcagtgacttgctttctgcaggggcagagacggatcagctgcagcagattattgttggctatcaatggggcgacatcaaaggggcttctgtcgtcgatttgacaccaacttggtatgtaaagtatgagaataactggttcaattatcaggaattaatggctaaattgacagaaacggggggagtttgattggatttcaagcgaatcgaatggatttttttcctagcgtttttggggttgaatgtctttttgttcaacatttacagtgaagcccgcagtgaacagcagaacgttttgcagtcaaatcagacgatcccgattgaacagcgactagcctcagaagacattaaatattcaggagaactttctgacgagtatttgagcgggtactatttaagcggtgaacaaaccgatttggctgctgctttgaaagaagcgcaaggggacaagcggttagtcgaggcgactactgtcaaaggacaacagttgactcatatttcctcgggtggtttctacattagtgatgatactcaggcagaaaagacggtcaatgaatacctgcagcgtaaagaccaggtactttatggagatgaataccattataggaaaaacttgtcgctgttggatcaagaatatccaaccattgttgctagccaatcctatgaaactattcccttcaatgatagctcaagtcggatcgatatgactttagaatcgtcagataaactgttgcagatcgctaagtatactcagacccacatttccaatatcaccccgctgcgggagaaaatgactctctattcagagaaagaagccgtcaacacgctttatttgaataataagttgcctagtcattctaagatattatggacagagctggcttacacaaggattttgattgttggtgatcggaatgtctacattccggcttggttcgttgctgtcaaagcagatgcggatgtaaatattcagatcgaaactgtcaatgcctttagtaatcgaatcattacaaacaatgcagtacaaaaagtagaaaatccatagaaaaataggtataatggaactcgttgaaagtaagagagaggaagacagaaacaatgatgaaggaaagtgcctttcaagtaagcattttagctagcggaagttcaggaaattcgttatatatcgagagcaacaaaaaacgaatcctagtggacgcaggactgagcggcaaaaagatcacttcattattggatgaagttggacgcaagccagaggatctagatgctattttggtcacccatgagcatcgcgaccatatccacggtgtaggggtcttggcgcgcaaatacaagttggatgtctacgcaaacacaaaaacatggcaagcaatggataatatggtaggcaatattgcggttgaacaaaaacatgtttttgaaatgggtaaagttttgacgatgggggatatggacatcgaaagttttggcgtttcccatgatgccgcagcaccacagttctatcggttccataaagatggcaaatcttttgtgatgttgaccgacacaggttattgcagcgatcatgttcgggggatcatcaaaggggccgatgcgtatcttgtcgaaagcaaccatgatttagaaatgctgcggatgggtccttatccttggagtctcaaacagcgcattcttggtgatcgaggacatctatccaatgaagatggggcactagtcatggcagatatattgacggataacacgaagcgagtttatctcgggcatttgagtaaagaaaacaacctaaaagagttagcccacctaactatggtcaatacgatgaaagaacatgacttaggtgtcggtgaggcctttgaggtttatgatacggatcccgataaagcgactgagttattcagtatttgaggatgagtggcgagcgtttttttgaagaaaacaacggtgatggaatgcggacagttttccaccaagccagagaatttatcttaagacaaaaaacgatgttgaaattttcaacatcgtttttttggctctttgtcaataaggactgatgggttgtacaaaatcaaatctgggtcagaatgaacctcattctggctcagattttttgttatcttactttgattaattgattgatcaaaaagattctaattctcatgttctcaaatgatttaaatccgtaggatactcgtttcattgtctttatatgggtattcttcgcttctatttttccattggtgtaaggatagatcatcgcgttggtgatgccttcttcataggtcagaaggttttggagcttttcccgaaagccgtcatctaacgtttcgggaagttctgccaataaggagaaaaataagtcagggtctttgtctcgaaaggcttcaactaattcatgaaaatagggatacgcctccttcagggacgtagaaaagccaagcaatcgatcaatcatcatcgcttccgtaagaaatgggtattttggtgctcgaaaacttttccatgttttgtattcataatggttgatgtttgcacgattttttagcaaaaagcgccagttctttttcagtttttctgcctgacttttctgtcctactttacgaagttcattcatttcacggatacgcaactcattaaaggcttgattcatgtgtttgataatatgaaaccgatcaatcactactttcgcatttggcagaatacgtttggtaagctggaagtaggcggcgttcatgtctgtgactaaaaattttacttcttcaggattagtgcagcctaagaaatagcttgttaatcgaggcaatttacgcgtaggcaagacatcaattaattgtcctgtttcgccatctgcgcaaataaagctcattttatcttctatggaagcgtgcgaacgaaattcatcaaccatcaatactctgggggagaatcctcttagattgctttggtaagtagcttttaaactctttcaacgtacgaataacggtggtcaaagatacctgacaatttttcgcaataaaagataaagatactttttcagtcagtaaagaagcaattttatatctgacatgattcgcgattgaatgtctgggttgaacaaaataactttgagccgtccaatgggttcgacagtttttacaggtatagcgctgcttttttaagcgcataaccaaaggcatgtgattgtattgttcaaagcggacaatcgtttccttcttcccatttttcactacaattactttcccgtttccatctaccacagtagaaccacaatttctacaggtatggggagcaggtgtgaaaacagcatcgacgatcaacgtctttttcttctgaaaggtctcgtaagagacctctgtaatcatcaaatctttctctattaatcgcagcatttttttgatagaatcattcatatagcatatcgtcctctcagttgtttattttgtcgtgatttaatcatactagagaacgatatgttttttaatacctaaaataaaaatggggctgaagaatcaattctgattcatcagtcccataaattatagagccgtttttttttgtgtcatggaaccttgatataaccggcgtgaaccaatagttgaatgataatgactagtgtattcattcccacgtgggtaatcatcgatgtccagatacgtcctgtcaacgcataaagtccagagaaaaagagtcccaatagaatatacaccaacaagtgattgtcactgtgtgcaaaggcaaaggcgacagcactgacaatgacacctatccaaatattcgaatagtttgcaatgattcccacaagggcacggcgaaatacaaattcttccatgataggtccgccaatcatagcggcaagggcaaaaatcgggttttgcagaataatagtgataatattctcagtattctgcgatgcagccacttcgccaaagagcgactcaataaagacagcgaagttttgcaaaagaatggcggcgatgattcctgttaggccataaacaataatagccgatacttttggctgcttgcgttcaaacgacagcggttcattttgtttaaaataaagaaaaatcatcaagattgcgccggcgatatacgaaacggttgtggcagggatcgtagcaccactagatataaaagcgacaggaataaaaaatgcgaccccataaatcaaaatcgtcgataatgcgtacttttttagagacataagtgaaatcatcacactcctttttttctattatagactagtgactcattagaaacaaaatttttccttaggtttttacggtatggagcaataaaaagaaaaagctaaaataaatttaatcaaaaggcttgcaaaaaaaacagaaaatgagtaatattaattttgtgagttagcactctatgtatgagagtgctaacggaaattctatcaaatacaattggagggatttatcgtgttaagaccattaggtgatcgcgtgattatcgaagtcgcaaaagaagaagaaaaaactgtgggaggtatcgtgcttgcttcagcagctaaagaaaaacctcaaacaggaaccgtcattgcagtcggtgaaggacgcacgctagaaaacggtgaaaaagctcctgttgctgtcaacgtgggcgaacaagtcatgttcgaaaaatacgctggcacagaagtgaaatttgaaggtaacgaatatttgatcgttgctgcaaaagacattattgcagtagttgaataaaaaataatttagttgaggtgaatgtaatcatggcaaaagaaatcaaatttgcagaagatgcacgtgcagcaatgttgcgtggggtagataaattagcagatacagtaaaagtaaccttaggccctaaaggtcgtaacgtcgttttagaaaaatcttatggttcaccattgatcacaaatgatggcgtaacgattgcaaaagaaatcgaactagatgatcatttcgaaaatatgggggcaaaacttgtttctgaagttgcttctaaaacaaatgacattgctggtgacggaacaacgacagcaacattgttaacacaagcgatcgttcgcgaaggactaaagaacgtgacagctggtgcgaatccattaggtattcgccgtgggatcgaaatggcaactaaagttgctgttgaagaactacacaacatttcttccatcgttgactcaaaagaagccattgcacaagttggtgctgtgtcttctggtagcgaacaagtcggaaaatacattgcagacgcgatggaaaaagtcggcaatgacggcgtaattaccatcgaagaatccaaagggatcgaaacagaattagatgtagtggaaggcatgcagtttgatcgcggttacctttcacaatacatggtcactgacaatgataaaatggaagctgctttagaaaatccatacatcttgatcacagacaaaaaaatctctaacatccaagacatcttgccattgttagaacaaatcttacaacaatcaaaaccattgttgatcatcgctgatgatgtcgacggtgaagcattaccaacacttgtattgaacaaaatccgcggtacattcaatgtcgtggcagtcaaagcaccaggctttggtgaccgtcgtaaagccatgttggaagacattgcgatcttgactggcggtactgttatcactgaagacttaggtttagaattgaaagatgcaacgatcgacaacctaggacaagcaagtaaagttgttgtggacaaagacaacacaacaatcgttgaaggtgctggcgacaaatcagcaatcgatgctcgtgtgcaattgatcaaaaatcaaattgctgatacaacatctgattttgaccgcgaaaaattacaagaacgcctagcgaaattagcaggcggtgtggcagtcatcaaagtgggtgcgccaactgaaacagaattaaaagaattgaaactacgcatcgaagacgcattgaacgctacgcgtgcagcagttgaagaaggaatggtatctggtgggggaactgcccttgtcaatgtcatcaacaaagtagcagccatcgaagcagacggcgatgcagcaaccggtgtgaaaatcgtcttgcgtgcgttagaagaaccagtacgtcaaatcgctgaaaatgctggctacgaaggatccgtgatcatcgacaaattgaaacacgcagatcttggcgttggtttcaatgcagcaactggcgaatgggtaaacatgcttgaagcaggaatcgttgacccaacgaaagtaacacgctctgcgttgcaaaatgccgcttctgtagccgcattattgttaacaactgaagcagtcgttgctgacaaaccagaacctgctgcaccagcagctccagcaatggatccatccatgggcatgggcggcatgatgtagttatactaaaagaaccccttagcaaggggttcttttctttatgcttctatttctatgatagaaaggagcaaataccaatggtccattgcttgctcattggtatattgaattccttatcattttggcattcaccgctaacatagctcaaaagagatactccatatttttacaccaaataggaattaacttcatgttgaatgattcagtgaagaagtttatgatcaatctatcaaatctatttcattttcattctctttttgagacacccactcttcctacaagagtgggtatttttgcttaaaaagtagtccttttactcaaaatgaacgtgcgccttactagcttgatttttattctaactagcaaggagcagtttcatgtagcacttttttatcaagacagcggatagcgctgcatattttctgtctgtcctaaaatgtaatctactgacacatcataaaaggcagcaagatgcaaaatcgtcataacgtctggtagacgatcaccagcttcgtaatccaaatagtcttccaacgatacatcgatttgctgcgatacctctttttgcgtcaatgcttgcccttctcgcaaaaatttgaatcggcaacgcaatgtatccaataaaaaagcttcttctaatgtcaatttgcgttcctcctcgaatggaaaaatgattgatgacttctctctccatttctattgtaacaacattctagaaataagcgaaatgattcacaacatcagaaataaacaaggagaaaaaaagaaaacaaagtgcttgctctggtacgcgtttcatagattattctattcatgaaaggggcgtatgaagatgcacacttatatggaagtaaagggaaacaatggaatacaacgctgctatgttgcacttgaatttgatgggatcaacttgattctcacgaagcccaagggattttttagagaaaaggtcgcacaaataccgcttgcagaaattgggcacctggtacaggatgaatattttggtgcgcaacgaatcagtttcattcatcaaaatgattattaccaattctatgaatgtggggcaagtgtgatagactatatgaaagaacaattatttgtctaaggagaagcgcatggcgaacattcgggatattgctaagctgaccggttattcggtctcaacgatttcacgagtcatcaataataatccttatgtggatgagcagaagcgtcaggagattttgcgggtaatggaacaagtcaactatatcccgaatcatacggcacgtgtgctaagctcgggaaaaacgaagaacatcggagtgattctcccatttgtcaatcatccgtattttgatatccttctaagcgggattactgcaagtgctttttcccgtgggtataaggtgactttgttgcctacccgctatgaaccagaaatggaagaaaagtacctgcaagaatttgcggcaaaagggtttgatgctctgattatcacatcaagagcaaatcccctcgaaaaactattgccctatcgtgcttatggccgcatcgttttttgtgaaaagatcgactctgtccaagatggatgcacctatatcgatcgtgaacaatccattcgggaagtgtttgcttatttgaaagaaaatggtatcgagcgtattggaattacacttggaagaagtcgtaagctgagcagcaattcgaagatcacagttcgtttgtgtcaggaatatttcccagcttttaccgaagaattgattttttgggattgtttgacggaagaagatgggcgagaggcagccgctttctttgctgataaaaatgtccaagcgatttttaccaatggggatcaggtagctgctggtatcaaattggcttcttcctccgaacgactacttattggcagagacaatttatttattagtgaagttcttcaattgtcaaccatcgactatcatttgcatgaatgtggagaaatggcgttgaagttagcaatccaagaagaacaagggtccatccggattccttatacgtttatcaaacgaagaggacttgagcacacataatgcggctcaagtcctttttatgggtcattaatctgcgtaatgagcgatgactgcctgtaaacagctggctgcgccttggcctgctttttgatcgtaatagtcagtaaaacgtgcatcatgaatgtacatttcacctaaactgcgatgataatcggcagaataaaatggcgctgcaagctgcagccattttttgtgcaactggaaggctgtttttgccaaagaagaagtcacgtcaaatggctcttgtaccacttgtttcaatgtttgaattagttcgttttcggtttgttccaattcttggtaggtttcaaatgacatgttctgccatttttgattgctttgttcaacgacttcttccccataagcggcacggatctcttcgccataggtttcttcattggctgcgagtttttgttgtttaaaataagtgaatttttctttatctgacatagtctgttctccttcataataattgattgtttgggctaatgttgtcaataagcgatcaagcgctgctcgttcctgagacaatcggttgtaatgagcaaccaacagtgtttgaacatcttgttcgggatcatctagcaaatgacggatttcttctagagggaggccaaaggatttaaagtacaaaatctgttgcagacgatccacttgctgtcccccataaatacgatagccggctgaattgatcctttgtggttttaataatccgatttgatcatagtagcgcaatgtacggctgctgacgccagaaattttagccagtgctgttatactatattccaaatttctccctccttatgctctcatcataaaggtttacgtaacgtcaatgtcaacaaaaaattttttgcttcgtcaaattatgttataattatagcaaagaaaggaagattcgatgcaaatagttttttccgatatagacgggacatttcaggaaatgggtcagcctgtccctgaaatcaataaaacagcgatcaactatctgaaagcacaaggcgatcattttgtttttgtgactggtcgagggtatgatctggtagaagcactgatgatagaagaaggaatctcctgtgatgtcatctttggcaatggcgccggcttgaagttggaaggtcaggcgcctgttttagccaattgtttgccgctagctaccttagaagcggtgacagctattttagagaaagaaaatgttttttattttctgcacaccgatcaaggagtgatctgcaaagatcctgcggattatcaagaacaattgaccgcattgaccaataaattagttacagatctcggtgagagaggggcgatgattgctgaatacaagcaagcctattttgtgcatgactgcattcatgcaccggatcttttagcctacattcaggaacggccgacgatcaatgtcctaaagatcgaactgatggaagcatcggatgaaaagatcgaacagttgcgtctattgctgcagactgaaccagtcagtgcgtttcagtcatttgttcagacattggaagtcgttgatcccttagcaacaaaaggagccgcgatcacgaattttatgcaggctttccctcatgcaaagagttttgggatcggggatggtgagaatgacttagccatgtttgaagtggtagatgtctctgttgcagtagccaatgcgagtgaatcgatccgtaacgtttgcgatcgtatgattcctagtgcagctgacggcggagtcggccaatttatcatggatgaactaatacgagaggatgttgtatatgaaattgattgaaacaccagtcaaccaaaatttgaatttggagacattttatccggtcatctcaaaatttatttttgataaagtcgcgattaaatactacaaactttattctcttgatcgaacccagatcatgtatgtggatacttttgacaagatcacattggttttgatcaacaataaaaagaagatcagccgcggagaagtggatacagcgattcatcgcttactaaaagttgaccgcaaggatgtcactgtagatgtcaatatccgtaaaaagatggaagcagcgggagtcaagtttgcgaaacctcgcaaagatatcatcctagttcaattagcagttgattaaccattagcagcctgtgttataagttgaagcaagacccaatgattcgagtgaaactggtggaataccccatcgcatcatgaagtttttcggtctttttctaacttatggcacagactttttttgaggaaaaaaacaagaaatactttctttttttatttttttgctataatagggagaagtaagtatgagggagcaaaacgatgcaaaaattatttaaagatgatagtttcactttgcatactgatctctatcagatcaatatgatgcaaacctattgggaattaggacgtgcggatttgaatgcagtcttcgagtgctatttccgtgacatgccctttgagaatggctatgctatctttgcagggttagaacgcttagtcgattatttgaacaatttgaccttttcagattcagatatcgattatttaagagaaatcggcggatatccggaggctttcttggattatctgaaagaattcaaatttgcctgcacggttcgttcagctttagaaggcgatctcgtcttcaacaatgagccgatcattcaagttgaaggacctttggcacaagctcaattgatcgaaacagccttattgaacatggttaatttccaaacattgattgcaacaaaagctgctcggatcaagtctgtgatcggagatgatcccttattagaatttgggtctcgtcgtgcgcaagaactggacgcagcgatttggggaactcgtgcggcttatatcggaggtgcgggtgccacaagtaatgttcgagcaggcaagatctttggcatccctgcaagcgggacgcatgctcattctcttgtgcaatcctatggcaatgattatgatgcctttatggcgtatgccaagacgcacaaagactgtgtctttttagtcgatacgtatgatacattgcgcttaggtgtaccaaatgcgattcgtgtcgcaaaagaactaggggatcaaatcaactttttaggagtacggatcgatagtggagacatggcttatatctccaaaaaagtccgagaacaactagatgaagctggctttacagaagctaagatctacgcatcaaatgatttggatgaaagcacgattctaagtctaaaaatgcaaaaagccaaaatcgatgtttggggtgtcggtacaaagttgatcaccgcctatgatcaaccggcattgggagccgtttataaactggtttcgatcgaaaacgaacaaggcgaaatgatcgatacgatcaaattatccggtaatgctgaaaaagtttctacaccaggcaagaaacaagtctggcgtatcacacgtaaaaaagacggcaagtctgaaggggattatgtgactctttgggacgaaaacccccaggaagaaaaagagttgttcatgttccatccggttcacacctttatcaataaaacagtgacagattttgatgctcgacctttgctgcaagacatttttgtagaaggacagcaagtctatcaattgccggatcttgaacacatcaaagcctatgctacaaattgtttggattcattatgggatgagtacaaacgagatttgaatccgcaaaaatacccagtcgatctctctcaagagtgctggaatcacaagatgcggaccattgaaaaagtgcgtacgcaaaccaaaacagaaattatttaattggtcctagaaagctaggaccaatcttcaaaaaaattaggaggcgtttctatgacattgcaacaagaaatcattcgcgagttaggcgtagttccaacaattgatgcgaaagcagagattcgtaatagcattgaatttttaaaagcatatcttcaaaaaaatccctttttgaaaactcttgttttagggatcagcggtggacaagattcaacactggctggtcgattggctcagttgacaatggaagaaatgcgcagtgagacgaatgatcccaattatcagttcattgcgatccgcttaccttatggagaacaggctgacgaagaagatgccaaaaaagccatcgaatttatcaaaccggacattacattacgagtgaatatcaaagcagccgtcgatgcgcaagtggcagccgtcgaagaagctggcttacctgtttctgattttaataaaggcaacatcaaggcacgtcagcggatgattactcaatatgccgttgcaggcgaaaaagctggcgctgttttaggaacagatcacgcggccgaaaacatcaccggtttctttacaaaatttggtgatggcggagctgacctcttgccgctatttcgtttgaataaacgtcaaggacgtcaattgttgcaagaattaggagcgccggaagcactgtacaaaaaggttcctactgctgatttggaagatggcaaaccaatgatcgctgacgaagtagcacttggtgtgacttatgatgagatcgatgattacttggaaggaaagaccgtttcaccaaatgcgcaacaaacgattgaaaattggtggcacaaaacacagcataaacggcatctgccaatatcaatctttgacgacttctggaaataaatcttttttactctgtgatagtttttggtccatcgcatctaggagaaaataaatatccgaacgatttatgaatgaattttttccgagaggcctcgctgtatcgctcaacgaggtcttctggatttcatagattgttcgggattttttgttttttttttatcttagtcataactctcttcaaggaagaatggcaagaataaaaaaacaaaacaagcaaacggctctttacattctaaatcgcaaagcataaaatacaggttatggttagaaaaggaggaatgtccttcgtgaaaagaaagattcatcccaagttgcagatggggctaaaactaatcggtagttttattttgattctctttagcaacctttatctacaatggtgtcaaaacaacctttctgttgagctagcattaaaatttgctttttcttggcacacagaaaagtttttcttagcttgtctggtgctgctgcttttctatgggttattgacaagtctggctggatcccttggagtcggggcgctgttttatagcattgtgatcgggatcttgggttatgcaaattacctcaagatggcttatcggcaagaaccaatctatccagatgatttgaaaatgatcactcagtttgatttgctgcatacgatgatcggaacaggccccttcgtcttggcgatgctatgtgtgatactcgcagtgggagcaattatctggagtatttatcgcagccgtaaattgtcaaaaaagaaacagatcctcagagggctgacaatgctcgtttgtacaattggtttggtttatgtttcgcattttaatgacagcaataatttgcttagaaaagcgtataaccggaccgcattatggatcccttattcacaaaaaatgaattactacaataccggttttattggtgggtttctattcaatctgcgggtcgatgcaatggaacaaccagcgggttattctgaagctgcgataaaagaaattgccaaaaaatataccgctgaagctggcgaaacaaacaaaacgcgtgaccaagaagcgccaaatatcgtttatgtcatgagcgaaagcttttctgatccgagccatctaaaaggactgacgattacaggggatcctttgaaggattattatgcggtagccgatcaaacgatcagtgggaaaatgttgtcgcaaaattatggtggcgggactgcaaacattgaatttgaagcattgaccagtttttcaatggggttgttgaatccgcaaatgaccacgccttacacgatgctggtccctaaattgacacaattgccttcagtggtctcattcttgcaaaaacaaggatatgatgcgacagcgatccacccctatgatacatcgatgtacaagcggaaagatgtctatgatgtgatgggttttcaaacctttttggatcaagacacgatgacttacacggacaagatcgagaacaatccttatatctcggatgcttctgcttataaagaagttctgtctcttttgtcagatgagaaaaagccgcaattcgttcacttggtgacgatgcagacccatatgccttatgaaggaaagtatcagacattaaattatcaagccacaggcgatggaaatataactgctcttgaaaactatctgcaagatatctcttacagtagtaccgcactaaaagactttattgaacaattgaagcagctgaatcgaagaacagtagtcgttttctggggggatcacctgccaggcatctactcggatgcgattaaagatcaaaatgatactgctgcgctgcatgaaacggaattcttgatggtggattctgatggaaccttttcaactgacactgttccggtaacgagtcccttttactttgcacctaacgtgttgaatgaaagtcagcaaccaatcaatggattttatgcgttgctgctagcactgcaagaaaaattgccggcttttgaacatgggcagtattaccaaggcgaacagtggcgaagtgagctaagcttagatgcgaaatcacggcagctatatgaagactatcagctgattcaatatgacattttacaaggaaaacaatatagtttacagacagatttatttggctaagaaaaattgtctaacataaaaaggctgtgacaaaagaaggatcaaggaagaaacacattgctcttattcagagtaggctggtttcttcgctaaatgtctttcttttgtcatagcctttatttattgagcaatcctagcgatgtgttttaagcagcatgtctctactaaggatcacagatttcttgtaggtcattatagatcttgccaagtccgttgctgattgaagtaagctgcttcattttcagcctgttcaacgattgatttcggataaccaagcactcgcagtagggcaatcgcattacggcttgttgaaggaccttgtttgaccttatagtcaaaagagataccgtcatcggctgtgacttgttcagaaaaatggatattgctgcagtcatttttcaatatttcagtcagttcaatatcatgagtcgcaataaaagccaaacttgtataacggctcaaccaatgaatgatactagcagaagcagcgatccgctcaatcgtattggttcccttcagtatctcatcgacaaagcaatagcagcgttctttttgctgaacttgttccaacaatcgtttgatcgacttgatttctgcaacaaaatagctatcgccctcaaacaaatcgtcttcgaccgccattgaggtcaacacatgaccaggttccatcgtaaaggattcagcaacagctgtttggatagtttgcgccaatagacaattgatagcgatgcttttgacataggtcgatttgccagaagcgtttgacccggttaccagtgtattggtttgccagtcgacatcattcatgacagcttcagtcagaaggggatgataggtcccttttgcgctgaccgttccttttttgaattcagggatacaagtgatcggcatataggtacggaaattaaggatcgcgcaagcaatttccaacttgcctaacaattcccataatgcgatcgcttgttgattgtatcgagccaataaggtaacgacgtaatggtacgagataaaaggcagcataaagatgatattgatgtattcaaaaagcatatcgccttcactgccattttttgaacgaaaagaaacgccgaatcgggggatttttttcagaggcagcagttcttttttgatttgctcttgtaatggtgtggcaagtttggcaatcttgttgccgcaggccactgtctgaactagatagcgcatactgttgagttctgtttctagtgtggcttttttgatcgaatagtaaaccgtattaaagaggacgcttatcaaaatcactgcaattcctggcaaaaagccaaaagctatcaaaatcagcccaacaatcggcaaacagcccaataaaataaagacaggcaagttgccaatactttctttcttccctgatgccagatagtttttggaaaagttattatccagtttcccaagttgggcaaaggtatattgggtatcttcgcgaatttttggattggctgcgaaaaaatcaattaacgcggtcagctgtcgatccggcttaaattgaaagttgcgcaactgctgatagagagcttcagaacctacactggagtaagtactgttgatcatttcaaaaacctcgaataagtctaagtcataccaagtaatgtcatcgatctcactatcatggggataaaaatctttctctaccatccaggcctttttgaggctttcttctttgtcaaagcgaggctgacgggggaattttccccattcttgtttgacgcgacgtcttaattttattcggttccaagtatctaagccaataataagtgcactaacgaacaagataatcaagataaccatatattttgcgtccatgtttttctccgtttctaggagcaaaagcaggatctagctcctgctccttctaagttaattgattttacgcaagacatcataaatgcgtgcgatgtcctgcgttgttcctcgcagttcaaaatcagctagaaatggaatctggaactgttcagcatattgtttggcagtcaggcagtattgataattgaaatttttgttgccgctgccgatcacaccgcgacaatagcgggcattatccgcataatcaatatactcccgcatggtttctgtcaaaatttcctgatccccattatctacgccgttgccgccttcaagataggtcggcacaaacacgacaaaaggttcgctttcttcttcgaaaatggaattgtcatcaatttctttgacggaccattctagaggatgcgctgttggctgctgggcggcatagtccattagtcgtttgacaaatgcccgggtatttcctgagattgaaatataaagtagtttcatgtcatcaccttccgtatccagtataacagaatcaaaataaaatagagcaggtcttttgtagccaaaggaaggaaaaataggtaaactaagtagatagaaaaggagtgagcatatgttttctgagatgcatcatgtggccattattgccagtgattaccaacgagcaaaatcattttatgtcgacaaattaggatttaaggtgatccgtgagcaccatcgtcccgaaaaaaacgataccaaaatcgatttggcttttggctcatctgagattgagttgtttatcgtggatcaaccacctaaacgagcaagttatccggaagcaaccggcttacgacacttggcttttcgagtaacaaacattgagaaaatggtagcagaacttgaaacaaaaggaattacgtgtgagccgattcgctttgacagctttacgaataaaaaaatgacattcttccaagacccagatgggttgccactggaactacacgaatagtatcgaggattcattcgaagcgcaacgacacttttttacttcggatgacaaaaaaatgctgttattctgaagaaaacacaaggaggagaaatcgtgattcgatttgcacaaaaagaagatcgttttgctatggcgaaacttgttttagtcattttaaaagatatggaattaccgtttgtggcagaaataggagaagaaaaaacgctcgagatcttggctgaagcgatgttagagcctgattatcgttatggttataccagaggattggtcaatgaaatcgatggacaagtggctggggttgcttttggttacccagataaagatgaacctaccattgatgaaccgttaacgaagattctggagtcctacggtttggataaagaaatgaaactgttcgttgatcaagaaacgttgcagaacgaatggtacttagataccatttgtgtcgatgaaaaattccgtggaaaaggggttggctcagctttattggctgcactgccaaaaattgcccaacgagatggctataccacaattggtttaagtgtcgataaagccaatacacacgccaaacgtctctatgaacgtcacggttttcaagtggttgctgaacgaaagatcagtggtcatctatatgatcatatgcaaaaagaaaccagttgagtatctcaactggtttcgttcgttaatcgtaactccaaatgttgctgggtcttgcgtttgcgattatagagccaataatccataatcgcagcaatacaaatgcaaactggcgcatcctcatcgttgaccacatcgatcacataataatcgccagtcaatagtgttgctttatccatttccatgatcttcttgttgaaatgatggatcgcataccgatgattgtagatatccccgtggacagcccaatggagctgttggatataataaaaatccccaggccagttgaaaattttttgtaacgtacctactttttcaaagtccttgtagatctcaaatcgtgtgccaaaggtaaaactgatttgcttaatactggcgaccagtgtgccgtccaaacgatagagggaaagtgcatcgcctttagttccccagcgcccgaccatcaagaataacgatttgcccttttcgtctttaacgatcgttcgcgtgatactgctgagttgtctgtcttgaataaaaaattccgacatatctacgcctcctcttgtatcccgaaaagctgcgtcaattataaattctcatcgattgcccgaataattgctttgccgactcctgattcaatgttagtatccgtcagatacttcgcatattctttgacttcgatttccccgttacccatagcaaagctgacaccagcaagctgtatcatgctgacatcattcaagttgtcaccaatcgtcatgacatccgacagttgaatcgctcgctctttagcaacgtgtgccaccgcgatccctttttgggcattgcgatgattgatttcaatattgttttgtccggaagaagtaaccactaagtcgccataaccatcgatttcttgtgtgatcggtcctaaaacacgcgcgccatcttgatggaagcaaatgatttttaagatttccagatcttcaatcgcaaacagttcattgaagtctttgacataattgatgggaagaaaagctagtcgtgcagcagtcatggcaatggccattttgtgggtcagatggggcattgcttctgctgtatggatcgcaaaattctcgattcggcgcgtctggctttctgaataaatgccattgctcgtggaaatctcaaaataaatgtctttttctcttaataagtccatcaatgaacgggttttttctttagaaataggaacggtgaataaagaagttcctgatttgtcaaacacttgtgcaccattaagtgtgatcatagcacaatcaataccggcttcttgcaaaggcggcagagcttctttccggttgcgcccagtggccaccatgaattcgactccttgggattgggcatatttgatcgcttggatattttcttctgaaatctgcatgttggcgtttagtaaagtaccatccatatcagaagcgattaattttatcattgtcagcgtcctttcttatggtttctatagaatagtgtaccacaaatcagcaattatttttgagaatgtcttcttgtttcttaggcagatcttttgttatccttaactaaaagcaaaggagcgagacgatgagaaagattttagaaaatgattggcaagaagttttgcaagcttccttcgatcaaacctattaccaacagttacgggaatttttgaaagtagaatatgcaacacagaagatccacccggcaatggaccatatttatgaagcactgaaactgactccgtatcatgaagtgaaagtagtgatcttaggacaagatccatatcatggtccgcatcaagcccatgggttatctttttcagtccaacccggagtacggattccgccttctttacgcaatatctataaggaattgcaaagtgatctaggcatcgcgccagtctctcacggttatttggttccttgggcgcaacaaggaattttactactaaatacggtgttgacagttcgtgaaggacaggcttattcgcatcgaggcaaaggatgggaacgattgacagatactatcatcgaaaagctgaatcaacgggataaaccagtgatctttgtattatggggaaaaccagcccagcaaaagaaagcgttgatcgatacgaaaaagcatatcatcatagaatctccccatccaagtccgttatctgccagtcgtggtttctttggatcgaaaccattttcaaaaatcaatcaagcattgatcgcattggatgaaacaccaattgactggcaattaccagaaaaaatagtacaggtgtgaaactgtagtagtgcagaagagacggactgtgaattgtgtaacaaaaattatctttttcgattagtacagcatttttatctgttcttttttttgcaactattgtacaatgtaagggtataaaaaaactggaggtctttacccgtggaactattcgaaagtttaaaatttaaaatcgtgcgtcgtcatatcaaaatcgttttcccagaagcaacagatcctcgtatccttggtgcagcaagccgtctacgttcagaagaattggtagaaccagttttgattggtaaccctgctgagattgagaaagcagcggaagctcgaggaatcaacatcgctaattttgagatcctagatcctgaaaactatgaccggtgggatgaaatggtcgaagcttttgttgagcgccgaaacggcaaagcaacaaaagagcaagccgaagaaatcttaaaagatgttaattattttggtacgatgttaacttacatggggatcactgaaggaatggtttcaggtgcgatccattcaacgggcgatacggttagacctgcattgcagatcattaaaacaaaaccaggcgtgagccgcacaagtggtgcctttttgatggttcgtggtcgtgatcaagaaaaatacctattttctgactgtgccatcaatgtgaacccttctgcccaagaattagcagagatcgctgttgattcagcaaaaacagcggaattatttgatatcgatccaaaagttgccatgcttagcttctcgacaaaaggttcagctaaagcaccagaagtcgataaagtggttgaagcaacaaaaattgcccaagaattggcgcctgagtacgaaatcgatggtgaattgcaattcgatgctgcttacatttcagctgtcgctcaattaaaagcaccagaatcagaagtagctggtaaagcaacggtctttgtcttcccagatttacaatctggaaacattggctacaaaatcgcacaacgcttcggtaacttcgaagcaattggaccaatcctgcaaggattgaacaaaccaatctcagacctttctcgcggatcaaacgaagaagacgtctacaaactatccatcattacagcagcacaaacattgatggataaataagataactaatcaaacaaccaagccgttccttttgtcaaggaacggctttttgctgcgaatcacaacgattggcttgcatagcaagacagagttgatgatgagcagtactaggcgaccaaagggagcgtagtaaccttcagcctgaatcacaacgattggcttgcatagcaagacagagttgatgatgagcagtactaggcgactaaagggagcgtagtaaccttcagcctgaatcactgcgattggcttgcatagcaagacagagttgatgatgagcagtactaggcgactaaagaaagcgtagtaaccttcagcctgaatcactgcgattggcttgcgaagcagagagcagatgatgagcagcggggaccaaagaaagcgtagtaaccttcagcctgaatcactgcgattggcttgcgaagcagagagcagatgatgagcagcggggatcaaagaaagcgtagtaaccttcagcctgaatcactgcgattggcttgcgaagcagagagcagatgatgagcagcggggaccaaagaaagcgtagtaacctcagtatgaatcacaacgattgcccttagagtggcatggaagtctagttagcgcaacaagcttagaaacaattgcaggcaaagcaagatgaggggcgtcgcttccaaaaatactgcccacagcaggataaaaatggcttttctttcaaactccttgcgacggtacgctctttacttttgattctaaaacaagctatactaactactaacagcaagtgaaaagataaaggacggatcaaacatgataacgatcgctgatttagatgcaacagaaaaatttgccgaagtgattggcagagtggccctgcctggagacaatttggtgttaactggggaactgggagccggtaaaacgacgttgaccaaagggatcgctcgaggtctggggatcagtcaactgatcaaaagcccaacctatacgattattcgtgaatatactgaaggtcggttgccactctatcatatggatatttaccgggtagaatttggcgcatcagacttgggattagatgattattttgaaggtgatggtctttctgtgatcgagtggggaaatcttctggaagagtctttaccggaagattatttggaactgattttggaaaaagataatacagaagagcaaaaacgttttgtgaaattgcttacatttggtccgaaagctgaggctttccaacagcgtattttggcgcaatgggaggcagataatgagtgacattcatttgacattgcgtgaggctcggggcgaagatgcggcagaactcttggcagtcagtcaaaagattggtcaagaaactgactttttggtcatggatgaaacaggcctcgccctgcctgaagcaatgttggcacagcaactagaaagcttgtatgaacaagacaatcacctcctattgttagcccttgatggagaacgaattattggtatggcttctatcaaaggttattcggaatggcgcatggcccatgtaggagaaataggtctatcgattttaaaagactattggggaatgggactagggtcacttcttttagaagaattgcttgaatgggtcagtgaagtagggttgttgacacgcttggagttgacggtccaagcgcgcaatgaacgagctatccatttatatcagaagtacggatttgaaattgaaggttgtatgaaacaagccgcccaaacaaaagatgggcaacgaattgatgttctaatgatggcaaaattagttgatgaggagtgagaaggatgatcctgcttgttgaaccggccctagcagacaaagaacagttaacagcttatcgcgcatcatttttagaagacaatgaaactatccacggaggttctgggctagaaacagcggagacaatcgaaaaatggcttgaactgcaagaagcctacaaatcaccggcaactgttcctgctagtcatgtcattagtcgggtttatcttgcaaaacaagcagatacagtcatcggaatcttgaatctgcggctagagctcaacgactatttgctgcagcaaggcggtcatatcggttattctgtgaaaaaaacgtatcgccaaaaaggatatgggacagcaatgcttgctcaatccttgtcgattgccaaaagcttcggaatagaaaaagtactggtgacatgcgatgctcacaatcaagcatctgctaaggtcattgaaaaaaatggtggtcaattagaagatatatggatcgatccggtaaatgggaatagtactcgtcgttattggctttcaacaaataactgaaagacaaaagagtaagaaagtaagaagaaaagtaaaaaactgatactcattttacgagtaccagtttttttaatgggtcgatcccgaaatcgttttcttgacgtaataagatctgagcacaggcacgactatcttcaagggcgtcgtggtgattcagcaaaggaatctgcagctgttggcagacagtattcagcttgtgattctcgaattcaggatagagtttgcggcttgtacgtactgtacagagtgaaagataatttggctgttctatcccatagtaatcaagacatccagctaaaacgccagtatcgaaaccagcattgtgggcaacgatcagactgttgagattataatattgctggatttgtttccaaatgtcaggaaatttaggagcattgacgacgtcttccggatgaatgccatggatttggatatttttccaaaagaaatctgtctccggctggatcaacgtgtagtattctccaacaattttactgtcccgaaccatgactaatgccaatgaacaagcactgtgcttttgataattggctgtttcaaagtccattgcgataaaattcattgccttcacctcaaagctattctagcacaaatctttgaaatgaaaagatacaagatttttttggcaggatggccgataggacacagcgaaagaatatggtaagcaattagtttaactgcaattcgacggggcaatgatcactgcctaagatttctgtatggatttttgcatcaaccaggcggtcatttaaatcgtctgaaacaacgaagtaatcgatgcgccatccagcattatttttgcgcgcattaaaccggtaactccaccaagaataaatcccttcagcatcgggataaaagtagcggaaagtatccgtaaagcctgctgaaagtaaggttgaaaatttttcccgttcttcaggagtgaagccggcgtttttttggttggttttccagtttttaagatcaatgttttgatgagcgacgttcaagtcaccgcataggataactggtttttgctgtttcagatcggtcagataggcacgaaaagcatcttcccatgtcatgcgataatcgagacgacgcaattcattttgggcgtttggtgtatagcaagtgactaaaaagaattcggggtattccagggtgatcacccggccttcggcatcatgttcctcgatgccaatcccataatgggcagcaagtgccggttctttagcaaagatcgctgtaccagagtatcctttcttttctgcataattccagtattgcgtgtatcctggcagatccaactcgatctgccctgcttgcagcttcgtttcttgcaaacaaaagaagtctgcatcgaaggtctcaaaggcttctaaaaagttctttttgacgattgctcgtaagccattcacgttccaagaaataaatttcatatttgtcctcctcggttcaactatattttccattctaccgaaaaaaagtgtaagattaaagcaagacgtaacgtttaggaggaatcagtcatgaagatcggtgttatcgggttaggaaatattgcacaaaaagcatacttgccaagttatattgcattgcaggatcaagcggatttttattttgccacccggcgtgaatccgttcagaaagaattgcagcaacgttatcggttggcgcatatgtacaccaatttagacgagctgatcgatcagggaatcgaggcttgtttcattcatacagctactggcagccactatgagttgatcaaaaaatgtctgacagaaggaatccatgtctttgtcgataaaccggtcagcgagaattttgctgaagtagaagaattgtttgctctagctaaagcaaaacaaaagttgttgatggtcggcttcaatcgccgctttgccccgatggtcgatcaattaaaacaaattccggataagcggatgatttatctgtcaaaacaccggcaagctgctagtcatgataccaagtatgtgatctatgatctcttcttacatttggtggatactggtgtctatttattggatgaaccgatcatcgcgcatactagtcagatcaaagaatcagcggatggattggagacggccacactgatcttggaaacagcacatacaacggcgattttgacgatggatctcaagagtggtgccaatacggaagattaccggatcaccgccaaaagcggaacctatgatgtgaggaatttgactgctcttacggagtatgtggaggggaaaacggtggaacatgagtttggcgattgggaaacaacgttgaacaaacgagggttctatccattagtttcggcatttattgcagcagtcgccgatccaacagctatcgatctgcgccaagcgcaagtgatagacagtcaccagctttgccaagaaatgatcgctgccaatcatcgggcaaaaagtgattctttagagaagtagcaacttttcaatgaacatgctaaaataaggaagatgtttaatgtgaaaggactctttcttgtgaataaagaattaatgatcaagcaatttccagaaattgcgttactaaaagatgaagctttattgaattatacgtatacgaaaacaggagggcctgcagatatcctggcttttcccaaatcagcaaaagaagtagaacaaattgtcgcctattgtcgagaaactgatactccttggttggtcttaggcaatgctagcaacttgatcgttcgtgatggtgggattcgcggtgttgtgatcatgctatcagaaatgaatcagataacggtagaagataccactttgatcgtcgaagcaggcgcgaagctgatcgatacaacgtatgtggcactccatgaatcgttgacaggatttgagtttgcttgcgggattccaggaagcgtcgggggagcggtatttatgaatgccggtgcttatgatggtgagattcaagatatttttgcgtcctgtgatgtcttgctcgcagatggacgcgtcgtgactatgatgaaagaagagatggcgttttcttatcgccacagtacgcttcaagaccaacatgcgatcattctgtcggctcgttttgatttggcgcaaggggatcaagatcaaatcaagaaacgaatggatgagttgacggaactccgtcagctgaaacaaccattagaatatccttcttgcggcagtgtcttcaagcggcctgttggtcatttcactggcaagttgattcaagacgccggtttacaaggattgaaatggggcggcgcgcaaatttctgaaaagcatgctggcttcatcgtcaatgtcgatcatgctacagcgacggactatgtggaactgatcgctcatatccaacaagtgatcaaggagcgatttgatgtccagttagagacagaagtgcgtattatcggagaagaagcaaaataattaaacatgttcgtaattgtgacaacgtctgatgacaaatcgatatctgaagaatgaatgtattgcaaggcttcgtaaggcatcgttgcgatgtatcgagaacctatagcattacttgaatctttcagaacggttgtttatttggacagttgtcacattttttattaaaaaaggcaatgggaaggctgtactatttgtctacccattccgtcttggctacaataaagaaaaggggaaaatggagggatagtatgaaaaagtggttgggtattggcttgttggttgggctattctttttaaccggttgtacgaaattaccgcaggatcagtttgctgatgggttaacagtacaaaaagatatgaatgctggtgactttagcgtgacgatcgatacatttgaatttgctggcgaggacagccaaaattcacaagcaagcatgatcgcagggatgattttctcccagttggcgggaaccaagatcacaggaaattttgttgaagatccaaaaagcaaaaatattcgtttggatgcctcactgtcttctggagaaatcgatgttccactgaatcttttgatcgatggcaagagccatgacacctacctttcagcagaaatcgttgaggcaatgagcaatctgtttgcatttgatacattcggtacatcggatacgtttgcatcggatacatttgatagtagcgaaacgccagatacgacggggaaagataaatatattcgtctgtcaccagatgagatgtcagatcttgacacggaccagctattgaacaatagcttattttcttctgagacattggcagagtatgtcaaaacgttggatcgtgaatcttttaaaagagatggtgacaccatcacgcatacattcacaaaacaagagctgttggactttgttgactatgccaaaaaacaaaaggcagacactagtgagattacgcagtgggaagatctgctgaaagacagtgagcgtattgatttgactgtatctgtcaatgcaaagaaacaaaaccaaaaagttgtgatgaacatgacccaatctggcgagctgcctttggctattgggatcacgtttactatcagcggcaaacaaagtgatgaaaaagtccagttacctgcttcagaaaatgtcgttgatcagcaagagttttttgattcctaccaagaagactctttttgggatgacagttattacggcgatgatcccctctctgatgaagattggacaaattatacgctaacagacgaggagtttgaccaattattagagatggttgccactgatctacagggcatgacggatgaagaaatcgttgattttttgttgatttatgaagacttactgaccgaagaacagtaccagcgtttggctgaggcattgcaagtaagccaaaatttatgagcagcataaaggaacactaaaaaaagagccattgaagcaagcttatcaagctgcttcaatggctctttttatttgaagttctttcaaatgaatcaaaaacgtggctttttcgtcaatctcagtaatacagaagcaacagccatggtcgcaattcctgcaacgatcgcctctgggataccttgtgtcaaaataacgccaaggatggcggtatagacggcagttccggcattaccgatcgcagcggcatattcttgttggaataaaaagtagatgaggttcatcacgagaatcgtattcgtcaatcctccagcgattccagcaatcagcaacgaagtgctttgccgcttgttttgccacattttctggcaggctttaaagacaaaataagggacgattccgatcagaatgcgaggaatcagagcaaccaagatcgctttccaacttccatgatccatgccatagactgggacaaatggcgagaacacaaaagaaagcggcgagatgatccacgttgaacggaccatactaatgatgccaaaagcccctcccagaaagccgccgatccgtggtcctaaaatgatggaagcaatgatcacgggaatgtgcatcgtagtagcattgatcggacctaaaggaatgaaccctagaaaaggaacggatgctaaaagaatcaagatccccaggaaaaatgcagttaaaactaaatcaaaagtggctatttttttcatgttagactcctcgtacttccaatgctgcaacagcttgttcaacgatcgcttccacggtcgccagcgcgccgcggccgaaatccccgcaagccaacaaggcttcgcgaggagcgatctcttgataaccgacctctttcaaaatggctagatttcgttgcacgattggattttgatacatattggtattcatcgctggtgcaatcagttttggtacctccgcagtcaatgccaaagcgaccgttgagatcagatcatctgctaaaccatgagccaatttaccaatcaagttggcactggctggcgcgatcaagaaaaggtccgcttgcttcgctaattcgatatggttgatccggtcaggttggcgttcttgcatcacatccacatggattggtcgcttagataatgactggagagtcaatggtgtgatgaattgcgtactattagcagtcatcatcacgtcgactgcataccctcgttttgtcaactcattcgcgatatccgctgctttataagcggagatacttccgctaatacctaataatacatgtttttgtttcattttaattcctccttatccaaggggctcttcatttttcaataatgtatctacgatcaatgcggcaatttctggcttagtatggccggtaccgatttttttatcggcagttagtaagtgaccaatatgctgatcttctttgatcgtagtcaagtcattggccaagacataatctgcttgatttttagctagactatcacgggctacttgaaaaagtgtttcttccgaaacatcgactaataatttgaaacccaccaactttgtctgaggttgttttgctttgattcgctggatcactttaggtgttttctttaagaccatcactagatgatcagtattcgaagagagtttgcctgactgttccattgactgtgctactaatgtctctaacaactcaggagatacttggttgtcaaattgtggaagcagctgattgatcgctgtcaagaatgcttcttgtgaccaactgttagcaggtgtgaaatcactgaccgccatgctgtggatcactgcaaagtaagtatgtgccgataataaggactcaagacaattcagtaatccaagagtgccttcgatagagtggaccgtcaatcgtgaatcgttagctggctgttttgcttgacgagttgtgacataatcaatttcaatccctttttctaataacgcttcagcgatggctttgcctaatgaacctgttgaatgattcgtgatcgaccgtactgaatcaattttttcggaagttccgccggcagtgatcaatattctcatgcttctgatgccaccttgacgatcgtccgaccttgatgggtaccggctaataaggatgcgagtgtttccggcaatgtttcaaaggtaatctcatgactatgcagctgatctgcgacataccagcctgttgctagacgttgccaaagttcgttacgagtggcagtgtcaacattgaccgagtcaataccgatcacgcggatgccgcgaagaataaagggtaaaaccgtcgtttcgatgttgatccccccagcatttccgcataaaaaggcaccgccgccgtaacggatttgcggcaataatgcggaaagaagggaaccaccgacggtatcaataactgccgctactgtctgcttcgccagcggtttgattttttctggttgccaatcagctggatcagtgattttggttgctcctaatgccaataaccagtctgcctcttttttacgagaaagtgcgacgatgtttgtatagcctaacttatgcaacaatgcgatgctgatacttccgacacctccggaagctccggtaatgacgatcggcgcttctttttcaagggcaagtttttcaagttcggtgacagccagtgccgcagtaaagccagcagtaccataacacatactatctttagccgataaagtttctggtcgtttgatcagccaatcagccggtacccgttggtattggctgaagccaccgggatgagaaacacctaggccgtaacctgtcagcagtacttggtcgccggttgaaaaatccggactttgactttcaatgacttcaccagccaagtcgatgcctggtgtcatcggataagtacggataacaccgccattttctttagctgctaaagcatctttataattgacatcggaataagcgactttgacaagaacgtctccctcaggtaaatctgtcagtttgcaggtctttaaagtggcagtaaatgttggttcatttgttacgatataagacgaaaattctgtcattcaaggcaactcctttaatggtttgaactcatgataccataatctggttgatttttaatcattgttgcgaaacagatgattattcatgagacaatttcttcgttagaatgagagaagagcattgagagctactgaatgaaaacggctaaataaaggcattatgtgacagctgctcattggctgcagctcatttagtcaataagaaagcttcgaaaaattctcttcaaaaaaggtaaaaaaagacttgttttttttagaaaagtttgtatactggaaaaagtgaaattaaacttgaagtttactattagcaaacttttttgtgggaattttttactatatttttgatcgagggggaatgtagatggagattggcgagaagctccgcaatttgcgggtccaaaaaaatctgacacaagaagaattaggggaacgaaccgatttatccaaagggtacatctcccaattagaaagggatttaagttcaccttcaatggaaactttttttacgattttagaagtccttggagtgaccccggaagaatttttccgtcaagaaaatgcagaccatcaagtggtctatcgagaagaagacagtacgagttattatgatgaagaaaatggctatgaactgcggtggctgattccagactcgaatgaaaaagagatggagccagtcgtgttgacttttgagaaagccggcgagtataagacatttgaaccttctttagcggaaacatttatttatgttttggaaggaacgattgcactgagcctcggggaatcagaatacaaagcacgtaagggacagtccatttattaccaagcaacagaaccgcatcaattgagaaatatcggccggcaaaaaagtcgcgccttgatcgttgtaactgattcttatttatgatttagggggaaaaagtgtgggaaaaacaattatttcgttcaataacgtggtcaagcgatttgatgacgatgaaaccgtcttgaaaaatgttagttttgatattgaagaagggcgtttttatacgcttttaggtccttcaggatgtgggaaaaccacgatcttacggatcattgccggattttccgaagcaacagaaggcgatgtttactttgatggccagcgtatcaacgatgttccggcaaatcagcgacaagttaatactgtctttcaggactatgcgttgtttccacatatgaacgtgttcgagaatgtggcttttggcttacggatcaagaagctgccgaaagacgaagtcacaaagaaagtcaaagaagcattgcgattggtccaacttccaggttacgaaaatcgtgagatcagtgaaatgtccggtggacagcgtcaacgggtggcgattgcgcgagcgatcgtcaatgagccgaaagttttactcttagatgagcctttgtcagctttagacttgaaattacgaacagacatgcagtacgaattgcgggaactgcagcagcgattaggaattacctttatctttgtgacccacgatcaagaagaagcattagcgatgagtgatgagatcttcgtcatgaataaaggaaagatcattcaaagtgggacaccggtagacatttatgacgagccgatcaatcattttgtggcggactttgtcggcgaaagtaatatcgtgaatggcacgatgatcgatgataatttagtcgagtttgtcggcaaacgcttcgagtgcgtggatggcggtatgcgggcgaatgaacccgttgaaatcgtgatccgcccagaagatctaagtttgaccaccgctgagaaagggaaattgatcgttgaggtagacacgcaattgttccgcggcgtacattatgaaatcatttgttacgatgaacaaggcaatgaatggatggtccattcgactagaaaagccaaagaaggcagcaagatcggtttgttttttgagcctgaagacattcatgtcatgcgtttcaatgaatcagaagaagattttgatgctcgtttagagagctacgaagattaggagggagcacatgacgaaaatgcgtcgtttctatgcaataccctatgtcttttggttattgctatttgttatcgcaccagtattattgatcgtctatcagtcctttttcgatatggatgggaatttttcactggtcaattatcaaagttatttaggttccggcaagtatttgatcatgacattgaactccgtgtggtatgcctttttgatcacattgatcacgctggtcatcagttatcctacggcttactttttgacaaaactacgtcataaagacttatggttactgctgattattttacctacatgggtcaatttgctgttaaaagcctatgcctttattggtatttttggtattcatggcagcgtcaatcattttttggaaatcatgggtgtcggaccaaaacagattttgttcaccgattttagctttttaacggtagcggtctatattgagctgccttttatgatcatgccgattttcaatgcactagaggagatgaatccttcattgattagtgcgagccgtgacttaggagcgaacagctatgagacttttcgccgggtcattctgcctttgtcattgaacggtgtcaaaagcggcgtacaagcagttttcattccttctctttcactcttcatgctgacacgtttgattggaggaaaccgtgtaatcacgttaggaactgcgattgagcagcatttccttgtgacacaaaactggggcatgggttcgacgatcggtgtgattttgattattgctatgttcttagtgatgctcctgacaggtgagaagaaaaaaggaggacaacgaaaatgaaaaaattccgctggtcaaatctttatcttgtcgttgtctttatcctattgtacgtcccaattttttatttgattttttattccttcaatgatggcggtacaatgaatgactttactgggtttacctttgaacattaccagtccgtctttcaagatacacgtctgatgatcattgtattgaatacctttatgctggcatttttatccgcccttttagcaacagtgatcggcacgttcggtgcgatggggatctactatacgaaaaaacggcgaacacgaacagcgttgttaagtttgaacaatgtcttactggtttctccagatgtcatcattggtgccagttttctgattttcttcacgatgatcggaaatttgttccgcggctttagcctaggtttttttagtgtgttactgtctcatgtggcctttagtattcccatcgttgttttgatggttttaccaaagctacaagaaatgaatgattccatgattgatgccgctcgtgacttaggtgccaataatctgcaagtcatcaagaacattattttgccgtttctgacaccgggagtcattgccggctatttcatggctttcacttattcactggatgattttgctgtgacgttctttgtaacagggaatggctttagcacactttctgtagaaatctattctcgtgcccgtcaggggatcagcctagaaatcaatgccttgagcacattggtctttttattctcaatgattctagtcgtagggtactactttatcagcaaagaaaatgtgtcgaaaaaactacgtaaaaatcggcgagcggaggtggcaaatctgcgatgaaaagattacaatctttgatcataggaattgtcgccatcattttggtactgctgtttggtgtacgggagttggaacattcttcaggaatggcgggcgccaaagttttgaatatctataactggggtgattatatcgatccagatcttttgaagaagtttgagaacgagaccggttataaggtcaattatgaaaccttcgattccaatgaagcgatgtttacgaaaattcagcaaggaggaacgtcctatgacattgccatcccaagtgaatatatgatccaaaaaatgatggaagagcacttgctgaaacctcttgatcacagcaagatcaaagggctagacaatattgatccccgctttttggatttaagttttgatcctgacaaccgctattcgatcccatatttttgggggactcttggtatcgtctataatgataaattttttgctgaaggtgaaatcaaggaatgggatgatctgtggaaaccagaactaaaagacagtatcatgctgatcgatggcgcgcgggaagtcatcggtctagggttaaacagtttggggtattcattgaacagcaaagacgacaaacagcttacagcagccttcaacaaattgcgcaaaatgacgccaaacatcaaagcaatcgtagcagacgaaatcaaaatgtatatggcaaacgaagaagcctctgtcgctgtcactttctcgggagaagcagccgatatgatgtatgagaatgaacatatccattatgtgatcccatccgaaggatccaatctttggtttgataatatggttattcccaaaacgtcaaaaaatgaagaaggggcctatgcatttttgaactttatgcttgaaccagaaaatgctgcccaaaatgctgagtatatcggttattccacaccaaacaaaaaagcactcgcgttattgccagatgaaatcacgcaagacaaacagttctatccttcagatgagctgatgaagcatttggaagtctatgaaaatctaggcgcccaatatttaggcatttataatgacctatttttggagttgaagatgtacaggagataatggtaaaactcagtaagaatggggatttatcaacgttctaaagagctaaaaatcgtcctttttctatctgagttttccaattttctaccaaaagcggctgaaaagccgctttttttgtgttattttattttttctaccacgtttttctaccagagatactttgctagaaaagctttgcgatagagatttttaccagacgatgttgaaaataaaaagacagaaacgcttgaccgtatatagacgttcatctatattgtatatagataattatctatatacaattcaataggaggtcctccatggaaaactatgaacagattgctaccatcatgagagccttagctgatccaaaaaggctgaaaattgttgacttactttctacagctgactctctttgtgcatgtgaagtgttggagcattttgactttactcaaccgacattatcacaccacatgaagcttttagagaaggcaggaattgtcaaagtaacgaaaaaaagtcaatggcatcattacgctttacaggaagattttgttgaggatttcctagtaattttgaaggaacttcttatcaaagaaaaatcaattagctagtaaacgataggagtcttatgaatgaacaatgtatctacggaagtaactgaaaaacctgcaataaattttttcgagaagtatctaacagtttgggtattgttatgtatggcagcaggcatgctaatcggaaagtttttacctagtgtcgcagaccgattagaaagctatcaagtattaaatacaaatattccaattgccgttttaacttgggttatgattttcccaatgatgatgaaaatcgattttaaatcaatactgaacgtccgaaaaacatatcaggggattatgatctctagcattacaagctggctaattaagccgttcttgatgtttggcttagcctctttcttcttttatgttgtttttagcaattttatcccagcagacttagcaaaagactatgtggctggagcggttttgttaggggcagcgccatgtaccgctatggtatttgtttggtcaaaccttacaaaaggtgatccagcacataccttggttcaagtatcaattaacgatttattaatcattgtcctatttgtaccaattgtttctttccttttaggagtaaataatgtgtttgtaccatggaatattctctttgcttctgtactactatttgtgctagtaccgttagttggtggggcattgacgagatacttcatgataaaacgtaagggaattgattactttaacaatcgcttcttaccaaagtttgactccattacaacgattggcttgttattgacattggtaatcatttttacttatcagggggatattattttaaacaatccgtttcacgttctcatgattgccgtgcctttagtcttacaaaatattattaccgcaaactttgcttattttacttgtaaatggacaaaacagcctcataatgtggcagctccagcagctttgattggtgcttcagacttttttgagttatcggttgccgtagcaattacgcttttcggtgtcaattcaccagttgtgctagtgacaacagttggtgttctgacagaagtgcctgttatgttgttattagtaaaattgatcaatggaacgaaagattggttcccgacaaaaggagaaaatgaatgaaaaaaatctatttcttatgtacgggcaattcctgtcgaagccaaatagcggaaggatttgctaaaaaatacttagatgattcttgggagattcgaagtgctggcgttgaaactcacggcttgaatcctagagcggtggctgtaatggaagaatctggaatcgatatttcgaatcaaacatctgacttgattgatttggactactttaatcagtccgatatgattattactctttgcggtgacgcagcagataagtgtcccatgatttcaaaggaaagcacacaccttcattgggatttagtagaccctgccaaagcgaaaggatctgaggcagaaattagaagtgcctttcgaaacacaagagatgaaatcaaaaagagaatgattgaattatcgcagcagttaaatgtgtaattcaaaaagggagcggggtaaggtatgtggacttggattagcgaccaattactaaaaatggtttggctaaatgatttgatggggaaattaattgagcgttttgggctttcgctagacatgttgcatttctaattgagcagaatattcaaccgctatctattcaagaacgattgggccatgcgaatattcaaattactttaggaacttacggtcacttatatgcaaagtcagatcaacaagtagttaacgcgattgataatgttcaagagggcgctattctttcgaaaaatgacgatttattgccagtctgagttttccactacgctaccagaagacagacaaatgctttcgtaccagtgtttttggttgagttgctcctgttgaagatgtatcgaaagtaagcatgcagctgattgactgatacaagggaaggaagcaagtttcaaaaatatctttccccattatgttttaaaatagttacagcttcctagcgacctgtagagagacagcaaaagtctttgtctacaggtttttttgtcttagaaaagagtcgctgagacaattggaagcagctgccctgcagaagaaatactaagcagtactaggtcgaaacaagaaatagtcccaaacaaagcgctatcctataaaaactaaaaatacaatgcgtcagttacagtaactttttttgaaaagggtcatgggtttatagccgtagtttttagaatgaatcagctaattcgaagataataatatggaatttttctagaaattatcgcatgaaatgacccttgattgagaacgccatgaaaggtgggagaaatgcagttgtgtatataagcgaaagctgtctcttctttccaaagaagactggatgattttggaatctgattttctttggcttaaagggtaaaatagtttgtttttttgggagattaaatttatactaatttttatagctaatttagtgacttgttaagtagatacgaaacaactcctgaattagaaaacaaatgaatgggaaagcgaatgtttgatgacagctatcattcgctttgctgaaccgtttgcctaaggagtggaatgttgtgccagatttagtaaagtttgtattggttatcttagttatttgggttatttatcaattggttacttctgttttatttagcttgtcgcaaaaagccgttaaaaaacgactgaagagtaataagatgacagatcaacaacttgtaaacttgtatcattctgttgcaaagtcaaatcaatataatacgatgcaagccatattttcttatggaattttttacaaaagtcatgaaaaacaaagtaatgaagtgtacaagttgtatcgagatgaaatggaaaaaagaaacttgctataaaagaaattttaaggtcacttatttttctgataagtaacatcaaacatagatatggctaaaaatagatccttctttgcaattttgtgaggagggctctatttttttgagcaaacaaaataaataggtgaataaaaagggactctttttttgatggaacatcgtctctgcgtttctactggtaatagtagtgtaacagtagaatttttaaagagtctagctagatatgcaatgctgcttatcaaagacaggatttcataaaaatctatgaatctagtttgtttaggggtattataaatatagcaacaaagtggataaacaatctggaggaggaagcatgattcaacaatttttgcaaaaatttacacgaaaaactgggaaagtagaacaatcattcgaagtagtatctaaagaacacagagaaataaaagggctttcttttgaacaaaacgaagatgaatcgatcgttatggactttttgaatcatatggacagagagtatgacacaacacctgcaggacggaaacagcaaggggatgcctttgagcaatttttggcagcggtctttcggctagcaaactacgatgttgagatcaccagaaaaagctatctgcaaggcaaacaggtctacactggtgatgacaatgtagacttgattttaagcaaagatgcggaacggattgctgttcaagccaaacattaccgcttgaacacgaaagcacccaacttgatcacgaaagagtttgtcaataaatattcaggaatctcagataaaaattggacaaataaactttttatcacaacatctttatttaatccccatgtttatttagagatcgagaagaatgaaaaagcacaaaacattgaatggtatgacaggtacgggttattgcagttgttgaacacattgatcccagaaacaatggaaaagcacatgtttttaaatagtttgccagaacaagtagtcaaatgtccggaatgtgaatcagggtttattgtccaaaaatggaataagcaaaaacatagctatttcaaaggatgtacgatgtttccagagtgtgcccatacggaaagtgtttcattcaggcacacacgtaaaagttttactacgtcctcaaaagaactagataatagcatttcttcttaggataactggtactctaaaaagctcatttgttgaacgaatcagacacttagtagaagaaaggaatgaaaagatgtttaatctcgctgttcgtggccacgacttaaccaaggtttgtgatccacaagatctcgcttgtcaaatcgctgaaaaaggcatcaaaaatgttcaatttgcactaaatgcttcatttccggaacttagtgctgctgcccagatcaatccgggaatggggactttttttaaaaatgaatttgggcaacagaatgttcaagtggcattgttgagctgctatagtaatttgattcatccagatcctcatgaacgagaaaagattctgcagaaatttgaacgctatctttttcatgcacgctattttggggcgtcaatggttgcttcggaaacgggttccgttattcccacacttggttacagtgaagaaaatttcacagatgaagtttttgatgagcttgtaactgttgtccagcggttggtaaaaaccggggaacgttatcaaacaatggttgggatcgaagcgggattaaatcaccccctattttccaatgaccgaattcaggaattgatcgcaagagttccttctgattttctgggcatcgtctatgaccctaccaatctcatcactccagaaacggcaagtaaacaagtagaaatcgttgcagaggcctttgagaagtttggtgaacgaattgtctgtctccacttgaaagactacgtgattgaagaggaccgcattgtttctgtccctttaggagaaggaatcattccttatcaagccattttacaaatcgttgaccaatacaaaccttattgctatgtcgtattggagggaacaaaagacgaagaaatcaaacgggcggttgctatgatagaggggctaagctgaatcgaatgaacccattggcaaaaaaatcatttgacgtcaaagaagtgattgcctctaatcgcgaacacatttagagagcacgcttatttaaaagaagcgacagcataagttagaatgggacaaacagacactagcgcataatcctgccaatattctgaattaacgctcaaaatatgcgatgaggatgtttgtgttctgtcccgttaaacgttaatctgtcgcttctttttttgttgggaatgatacgttctaattgaggctgttttattcgttgatctgccaatgacgaatcctatggatcagctgttctttctctttttcactggcaaaggaatggcgggcggcggtctcattcaataagcgcagctcactttccgacatttggcagtgacgggtcatgtgtatgtattcatcagtcaatgttgttttagaaacggtgcggttatctgtgtttaagcaaaaagggaccccagctgtcagccattccctgaaaggatattggtgataatccgtgatggctttggtatgcacattactagtaggacaaccttcaatacagatttgattgcgggagacaaaatcttgggctttcttatcccctttcaaaatgataccgtggccaatgcgttttgcaccactttcgattgcttgatagacattacggatacagccgcattcaccggcatgcaatgtcaattgcacgttttgaccgtctatgaaaagttggtaagtttgcgctaatttgggaacatagtcatcttcttcaggaccagctaaatcgatgcccacaactttctcttcagaaacagactccgaaaaaatctgggagattgcagcagcagactcttgccgcatcccgatgatcaagatattcccttttaccggatagatggactccgcacgagcgatccctctagctactgcttgaatcgtttgtgggcaggaaagaccctgttccattgactgactaggagcaaagcggatttcgatatacgcgacaccatcttcaaacgcttgttccatgacatcaaacgctgcggcttctaatgcaaattcactttggagataaggaagaacgaaatcaaagcgttccaagtactcattaagatcagaacagtcttggggggcttgcatccgttcttcaaggatcgacagttcttgtgggataggcagattttgctgattggcgatcttaagtaatgtttctggacgaatcgatccatccaaatggcagtgcaattctactttagggaaggcttggatttggcttttcgttaacacgtcattcctcctcgcatacgcagggtacgctgaatttttttatgtatgaatatagcatagatacgggttatgtgctagtgaaaaaaggaaattctcatgataaacactctccctctcaaaaaagcttctataaaaagcctctataaaaagcctctataaaaagcctctataaaaagcctctataaaaagcctctataaaaagcctctataaaaaagctccggtcaaaaaagctcgtatcaaaaaagccgctgccatgggaggattgtcccatggcagcgtacgattttgttgagttggcactttttttgctgagaaaactaaatcagctctgagagttcgacggcatcgatcgccagatcttgtgcggcttccttcaacgtgaagtgaccgtcaaatgcgatgacaccacgcgccagtgcagcgtttgttcttaatgccttttcaggatcggcagccaattgtttagcgtagggtaatgtggcgatactcaatgccaatgtagcagtctgtggaactgcgccaggcatattggcaacagcataatggatcacattttcttggatgtaggtaggatcgtcatgagtagtgacacgatcttctgtctcaaaaatgcctccttgatcaatcgcaatatctacaatcactgatttttctgccatggttttcaccatctcacgagttactagatttggcgcttttttgcctggcagcaagacggcgccaatcaccaagtctgcttgttgaatagcggcttcaatgttgaaacgattagagaagagtgtctgaacttgtccgtcaaatagctggtctaattcttgtaagcgtgggatggatacatcgagaatcgtgacttgcgtcccaagccctaacgccattttcgcggcattggttccggcaacgccaccaccaataatcgtgacctgaccttttcgaacacccgggacaccggacaggaggactcctttgccgccatagattttttctaagaattgtgcgccgatctgaactgccattcgaccagcaatttcactcattggagagaggagaggcagcgtcccattagccagttggacattctcatagccaatcgctcgaaccttggagaacatgagcgcttttgctaattctggattggcagcaacatgtaggtaagtaaataacagcaatcccgctcttaagtaggaatactcttctggcagcggatctttgactttcatcaccatgtcagccgcccagacgtctgcagcgttagcaacgatcgttgcgccgactgctcgataggcttcgtctgaaaaagttgatccgatacctgcatttgcttcaaccaagacctcgtgcccttcttgaaccaattcatagacgccagctggcggcaaagctacacgattttcattgttcttgatttctttaggaattccgattttcatatgcgtcacacctttctttcttctattataaaggaaagcggatccattgtaaggagaaagcgaagatttctcaaggtagccgtcaagaggcgcggtcattatcaacatgcattgatgaggactatttataaaaaaactacctatagagtgtcaagaaagaggtaatcgtgcttgatccttcctgacaacttataggtagtttcttttttataaattagtactttcgtcctctgtaaatgtccaaaaatgtaaactttgagcagcgatttcttccaatgaataggacgttaaataatgttttttttccggcgtatcgtttggatctaaaacaaccacattttcgtcttgcatagcagccaacaccatgatatgaccagtatctgtgaaatctccactggtcacagagacgatcactggctgtccaactgccagataattggctacttgcgctgtgtctgtgcccaaatcgtgatacgagtaaccaaaggaatccgcaaaatcagagaaaatccgccaatcggttccttgcccatcgacatagtagctatcttgtgcccaatccaaaacttcaagcggcgaaacattatcctctcgcaaataagcgagtaccattgaaagagagagcagggcacagccattatcgcttaaagtttgcgtaccatctgaaccataggaataatcagcccattcttcatttgtttgtaggtaaagaggcgtagtcactccattttcttgtaaatactcgttcgcttgttcattgtaagctgcttgatcaaaatccatgtcatccatcatgggatattcttcataatcttggctggaatagctcacatgagaaagtcggataaatgcagcaaaaatcaataataaacccaacaaaacaagaaaaacataacgctttctttgtttcccttttttcttcatagcttccctcctgaagtagcgtgccttttttgccttacttcaagtaaagcagagggaatgaaggttgtcatccgcctgtggactgattcgtgtcggttgtttctagttcttccaattccagactcgtgttttcccaagcttccatcagctgttcttgggtggcttggacagtctccattgcttgattcagcgaagacaaacggacgtggtcgttcaatgcgtcaggacgagtcatcgcttgttcgatttcttcaagctctgcttcggttttggctaggtctgcttcaatttgagtgactttacgctgcaatgagcgaatggctttttgttgttctttgctctggaagaaagattgtttgccttgtgagatggctttctcttgaacatcagattgctgcatcgcagctagttctgtttcttccagttttttctccacgtaataatcatagtcccctaaatacaatttgctgccggtttcagataattcaatgactttggtcgcgattcgattgataaagtagcggtcatgagaaacaaaaagcaatgtgccttcataatcaatcaaggcattttcgagtacttctttgctgtcgatgtccaagtggttagtcggttcatctaagatcaggaagttgtcatgatccatcgcaagttttgctaaagcgacccgtgccttttcgccgccactgagcaatgtgattggtttttcaacatcttcaccagaaaaaaggaaacttcctaaaattgtgcggatctctacttctggcgtagtggggtgctcatcccataattctttcaagattgtttttgttgaatggagatctgattgggtttgatcataatacccaattgagacattggcacctagatgaacgtcaccgcgaatcaaaggaatcttgtggatcagtgattttaataatgtcgatttgccaattccattagggccgactaatgcaatggcatctttccggcgaacatccaaatcgatcagctcggatagaacagtctcttgataaccgatggctgcgttggctacttgcattaccacattgccagaaggtttactgattgaaaaaaggaaatttgcggatttttcatctccttgaggccgatcgagccgctccattttttctaattgtttgcgccggctttgcgcccgtttagttgtggaggcacgaactaaattacgcgctacaaagtcttctaatttattgatttcttcttgttgtttttcgaaagctttccattcactttgcagctgctcggctttcaaaaccagataacgactgtaattccctttgtaatggtgcattttccgtcggctaagctcatagacctcattgacgactttatctaagaaataacggtcatgagatacaatcaaaagagcaccggcatacccttgaagatagttttcaagccaagacaatgtctcaatatccaggtggttagtcggttcatccaaaatcaaaatatctggcttttgcaacagcatctttgctagtgctagacgagttttttgaccaccagacaatgtttcaatggattgctcataaaaagtgccgtcgaacttaaagccgtgtagaacagaacggatctcattttcatatccgtagccgtttttttcggcaaattcatgttgtagctggtcatattcttttaatagaccatcataattgactgctgtcgggtctgtttctgaaatggcgacttctaatgagcgcatccgctgttccatctgtcgaatgccggcaaaagccgtcaacatttcttcccagactgtagcagtactgtttaaaccagtgtcttgggcaagataacctagtgtcgcagttttatttttggcgatcgttcctttatcggggctttcgatcccggcaatgatttttaacagggtcgattttccggcgccatttcttcccacaagcgcgatccgggaatggctagcaatctctaggttgatattctcaaataaaacttcagcgccaaatagtctggcgatttgatttgcttgtaatagtatcatatgtattcattcctattcttgaagtcacttgtctccttggttgcaatactatcagtctatcacattttgtgataaacagcgattatgaaaaaagaatgattgtatcattaaacaaaaaaaatttcaaattgtgagcaatcaaattgatttttgagcaaactatttgatatgatagctacatcacacgtgaatttttcacaatgggggagtatttcttgaaagatcatcaaattccaaaggcaacagcgaaacgtttgcctttgtattaccgctatttacgcatcttgcacaatgctggaaagttgaaggtttcatctactgaattaagcgaagctgtccaagtggatagcgcaacgattcgtcgcgacttctcttattttggggaattgggaaaacgcggctatggctatgacgtggaaagcctgatgcagttttttgctaaaacgttgaatgaagaccatatgacaaatgtcgcgctagtaggtgttggtaatctaggtagcgcactgttaaaatataaattccatcagagcaatagcattcggatcagtgctgcatttgatgtgaatgaagatatcgtaggacgaatcgtggatggcgttcctgtctatccaatgagcgatatgaaagaacaagtgaagatccaacagatcgatgtcgcgatcttgacggttcccgcacaacattcgcaagacttagtcaatgagcttgtgaaagcagggatcaaaggaatcttgaactttacgcctgcgcgcatcactgcaccaaaaggtgtgctgatccaaaatgttgatttgaccaatgaattacaaacactgatttatttcttgcattctggcaacgtcttaacgacagatcaaccggaaaaccacgaaacgactgaatcagaataaaacccaaaaacactgtctttccatcaaccttcgcgtctagtaggtgatggaaagacagtgtttttttattccatcagttgatcaaaaagatcgtcataagagatggtctcggttttggtcaaggcagtcctatagcgatcaataatagcagccagcctattaaaatcaatgattcgtgcttctctgtggcgttcatctccttgaaaataaagaaggacgacaggagcagtcaatgctgaaaattggccagccgcctctgggacttccgctacattgacagcataaagtggaacatgcttttctaaagctaatttattaagacgaggtttgtctgctaagcagacactgcaagccggctgtgagagataaataagtgccaatggggtttcttttatcttcgtcagcagttcatctaatgtattcatttgtatcatgcaaattcctccaagcagattctctgtctaatgtacgttttgagggacaacttgtcaaagaaactgctggaaaagaataaaaactaaagcaagctttaaggtgccagcaaagactgtaaaaaacattgtgcattgaggcaaaaaaacgtatagtagttccagcgcaattatttttttataaagaaggttgaatatatgttacaaagcttacctaattctgttttgcagatgagcgtgatctttctctccatcgtcattgaagccttgccttttgtcttattaggctgcttgatttcaggggcgctgcaagtttttctgacgccagaacgagtgacaaaaatcctgccaaagaataaattggcctccattgcaatggggtgtggtttaggcgttttcttcccgtcttgtgaatgtggaatcgttccgatcgtcaatcaattcgtcaaaaaagacgtaccagtctacacggcttttgcttttatgctgacagcccctattgtgaatcccattgtaattttttcgacattcatcgcatttggcaattcagcgaagtttgcctttttgcgagtacttggcagcttgttggtggcaatggcggtaggtgtttggctggcttatttcagtaagcgagagattttgaaaacccaattgatcacagcttcagaggatacccatcaaggacattaccatgggcatgctcatgatacaggttctgagaaacgaaaatggtcccatcaaatacggcatttgttgcaacacagtattgatgaattcttcgatactggtcggtatttgatcattggcggattgattgcagcagcgatgcagacgtatttgccaacgggaatgatgttgactttgggttctacgaaattcttggcggtattggtcatgcttgttttggcattgacgatgtcgctgtgctctgaagcagatgcgtttatcggttcttcgctgcttagtctgttcggcgccggtccagtcgtgggttttctggtctttggtcctatggtggacatcaagaatcttctgatgatgaaacgatattttaccggtcgttttattgcaacaatggtgggattaattgctgttgtagtctcaatttatgcatgggtggtgtaaacaatgatccgttttttgattttatctggatattttgagttgatgatgtacttgcaggtatcaggaaaactgaatcagttcatcaatgtccactatcgttatctagcgattctttcgatgattgtcgctttatttttggcattagtccagttgtatttttgggtcaaacaaacgcctgatgaacatgaagatgagcatcaccatggactcgaaaaaaaatctcagcgcctcattgcgtatttcttattagcattgccaatcattgttggtttgtttttcccaacagtcagtctggatacgaccattgttgaagcaaaagggtttaatttcccgctgagtgaagagtctgtcggcgatcccgaaatgaatacccaataccttaaaccagatactagtctttattacaataaagatgattatgacgagcaaatgacgacttcgttagcgaagtatgccgataaacaaacgattgctgtcaccgacgagaattatttggaactcatggaattgatctatacgtatccaagtgaatttatcgggaaaaaaatcagctatgacggttttgtttatcatgcagcgcaagatgatcgtaatgaaatctttctgtttcgttttgggatcattcactgtgtagcggattcaggtgtttttggattacgtgttgagttacctgaacaaacggttaccgagaatgaccaatggctgcacattgaaggaaccatccagtcgcaatactatcaaccctttaaacgagatttgccaatggtagtcgttgaccaagaacaaaccatcgaggcaccggctaaccaatatgtttatcgatcattctagcgaaatgagagaaatgtcggtttttttgaaaaagttcacaaaaatatcataaagctttgttataataaagataaactagtgcagatgtttgtagttttacaaaacgtcgagtacaatagaaacgtacaatgtgctaaaaaacaatataaagagaggtgtcgtgaaatgggttttacagatgaaacagtacggtttgattttgatgatagccgcaagaaagaaatcagtgaaacactggctatcgtgtatcgtgcattagaagaaaaaggttataatccaatcaatcaaatcgtcggttatctcctttctggcgacccggcttacattcctcgttatcgggatgcccggaacttgattcgtcgtcatgaacgcgatgagattttggaagttttgattcgttattacttaggaaatcacgggatcaacctataatgagagtcatgggtttagatgtcggttcacgaacagttggtgtagctgttagtgatcctatgggatggactgcgcaagggatcgagatcattcgaatcaacgaagatgaaaatgactttggctatgatcgtcttggagaattagtcaaagagtatgaagtgactcgttttgtggtgggactgcccaagaatatgaataacaccattggtccaagagcagaggcttcactagcttacggcaaggccatcgaagaacgttttgatttgcctgttgactaccaagacgaacgcttgacgactgttcaagcagaacgaatgctagttgaacaagccaacacatctcgtgccaaacgtaagaaagtcattgacaaattagcagcagtaatgattttgcagaattatttagatggtgctggaaaacaactgttttagtttacagaaaagaggaaaaaaaatgtcagaacatacgcatgatcacaatcatgatcacaaccacgaccatgaaggtcacgaacacattacattggtcgatgatcaaggcaatgaaacattatacgaaattcttttgacagtagatggacaagaagaatttggacgcaactacgtgttgctttatccagctggagtcccagaagaagaagatgtcgaattacaagcctatgcctacgttgaaaacgaagatggtacagaaggcgaattagaacaaattgaaacagaagctgaatgggacatgatcgaagaagtctttaacacattcatggctgaagaagaatctgaataaagaattgatggctgaacctttgatagtcaagggttcagcttttttatctaaaaaaccgtcagaaatgaaatagctcatttctgatggttttttttttgaattttaccacagccagttttacataaatcagttaactagaaaacaaagtttgtagtttttgatgatggacttctagaaggcgttgatataaatcagtttcgaaatcactgtaatggcaataatcaaggaccgtatatttaaaaggatctaggcccttcggaatcagcaaaggtgaccccaagatgataaagtcatattcttcagtgattggaagtgtcagctgttcgatagcaacaaatgggatctttttgcctaggtttaagatctcagcggaaatcagatgctcagaaacattgacaaaaccaactttcaacttatagttttcgtcgatttctgaataatacggataaagcaaacaagcttggatgaaagctaattcacttacacaagatttcagccacgtataatttttccgttgggaaaattttttccagaagccttcgattttgattgtcaagatatgtaagagtgggtacttttctttgatatacgaagaaataaacaatgtggtcaaagggattttttgtttgaacaagctaaagttaccaatcgataggtagatgttcaaatatagagctggctcattttcaaaatgaaacgtaccgataaacgtctgacaatggtcttggaattcgtccaaaatctccttggggtcattacttggttgctgataagaatgttggatgatcggcagacgaatgtcttggttggaagtcagaaacggccaataataaaacaaatagaacaaagagtttacctccaagaggtctaaacgcagattggcgatcttgaagaaatcgtaaaagaagttgaggtctgtaccacttggaatgaaagaatcccttgataagtgatagatatcagtaaagtggctgtttttgatcctcagcaaacaaatcagacaatggagactggcttgtttttttcctaagtcaaacttgttcttatgctgtgcttcttcatgtttataaatcaatgctctcacttcttggctataaggaactatgtccaaactttcacctaatgatacaaaccaaaagaaattaaaaaagaggatacgaatcaacatttcggaacctgacaaggtcagattcgataaattcaagttgatattgtattccttcaaatattcaaccagcttttttgtttgacgaaaacaggtcgagcgactgatatagtgccggttacaaaaagcagcgagatcgtcgtcctcttctattagcatactgagcaacaatttataaggaacactttcagttgaaaggtaatgttggtattgggtgtattgaacaagttgttcattgacggttaacttatttttactatgtaatagcttgatggtagtaaatttttctaaatcatcttggattgcgctcaagatttttttgaagcgtgcagggccgtaataaaaatccaagttttcccgcacctgatctatgctgtattccccgggtgagagtgtcatcaacttgccgtagacactcaatttcgttctggcatgatcatctaacaaaattttttcaatcaattgatcaccttcctttttttgtaattattattattagcgtatttaatttctcttgtaaatacgtgtctcagatttctaacaagtctatacaaggtttagaaatatttctatttcacttgtctcaaaaatagcgttcagcgagtatgttttttgagagaaaagaaataacccacaattttaaataacgatatcaatattttttttgcttccttgttagtgtgtttaatggatataaataactataattgaatatttagaagctgaaggggaaagaattagaaatattagtgaatcttttctttttttttattatctatttgaattttaaaaaaatttcgaaggaggcactaaaaatgaaaaagggaaagcatcttgtccttcttagtttgttggccatctttttcatcgcttacttatattctcaacacataaacaaggtagtagcaaatgatgaagatgttgttgatgtagtagaggtgttgaaaaatgattatggagaagtgagtatcaagcaaacagatgatcatttgatcctcttttatcgcttaaatgagtcaacacaagaaagacgatttttatttcagctgcatgccaaggatgcagctgaaaacaatttgcttacttcttacacttctcaggaataccaagaatatacagatgagaagcaacagaaatacatggacgtcagacaaatcaaaggcgaaacactttgtcagcggcaatcgttatgaaataggagaagaggactttgtcgagagtgctgcggctaaaggacaaatgatcgtcgctggtttagaggtcggagagtatgtattggaggaagtcaaagcgcctgaaaatgctgagatgattgccgaccaaacaactacgctatttaccatcatttcaggaagtcaaatgcctgtagcaaagacggtaaaaaatgatacgactaaagtagaaaaagacacgccccaattagaaggacaagatgtagccatcggtgaagcaatcaactatgagatcactgtcaatatacctgatgggattgccgataaagaggaggagagcaacaagtatacctcattcaaattgatcgatagccacgatcctgcattgacatttatgaatcagtccaagggagaaacaagctatgcactctatgatggtgaacgtctcattgatactaataattatcagatcactgaacatgccaatggttttacagtagcaattgcgcccacatatatcccttccctgactccaggtggaacgttgcgattcgtttattacatgtatttgaatcaactagcagatccgacgaaaggttataaaaacgaagcaaatgtcgataatggtcacacgacagatcaaacaccaccgactgttgaggttctgacagggggaaaaagattcataaaagtagatggggcagtgattgagctacggccattggcaggtgcatcgtttgtcgtacgcgacgaaaattcggcgaccgcgaactatttgatcattgatccagtcacaaaagcagtggcgtggacgaattctccggagaaagcaacaactttcaatacaacgaacgatggattagtagacattacaggattagcttatggaacctactatttggaagaaaccaaagcaccgaatagctatatcaaattaaatgaacgaattgctttcaaagtagatgcacaatcttatgcggtggcgaatgaattggttactccagaaaaagtaccaaacaaacagaaaggaacattaccagcaactggcggcgagggagttactttgtatattggtttaggtgtcgttttattgacgatagtaggtgtctactggataaaaagatataaggcttagtgtcaaacgaagaacgaatggatagctgaggagaatgaaatgaagcaaaaaaaaggcatactttagatctaatcatgctattggtattttttatcggtatcctcagcttggcgtatccctttgttagcgatacattgaatgactatctcgatcaacaaatcatcaaaaactatcagaaaaaagcaaaatctgaacatgcgtcagtgattgctgagttgaacaagcagatgcgtgaagcaaatgaaaaaatggcatcaaatgaacctaagacagaagcagacccattttccaaggaaaaaaaggaaaagcagaactcgctgaaatcttatatagaagcacacacgataggtgttttgacgatcccaaaaatcaatgtcaatttaccaatctttgatcagacgacaacaaaactattggagaaaggggcctgtctgctcgagggaacttcatatccagtcggaggagtatcgacgcatgcggtactttctagtcaccgaggattaccacaagcaaaactctttacagatctacctcggttacagatagaggatcgcttttatatcgaaatcaatggtcaatatcttgcgtatcaaatcgatcaaatacaaactgtcgcgccgacaaaaacagaaacacttcagatccaagataaccaagacctggtcacactagttacttgcaccccttatatgatcaatagtcaccgtttgctggttcgcggacacagggtcgcagttgagcaagaggaaataagcgcgtcattgtcaaaagtgcagcaagcaaaacgaacgacctttttactcgtgactggtttgatcgttgtccttttgatgctgtctttggtgatggtgataaaacattttacaaaagttaaaaatacatgtagttttaaaaactagattcaaaagttttggtaatcagatagtttttcgagtataatggagtcgaagaaatgaaacggagtggatcaagatggagatagaatttagtcgaaagtatcaaatcatcaatgaagtattaaatgcagtgacccatgggatcgcagcgttgttaagtttgttttgctttaatttgctgatggatcgcgcccataccaccttagattatgtcgcttttgcgatttatggaagttcgctttttctgcttttcttttcctctacgttatttcatagcctgatttttacgaaggcaaagaaagttttccaagtattcgatcattgctcgatctatctcttgatcgctggtacgtataccccattttgcctcttagtcgtacagggaatggctgggttgatcttgcttagtgtcatttggaccaccgcagtaatagggattatttacaaatctttgaggttgacaaaaacgaacaaagtatcgaaagtttcaacgatcatctacaatgtgatggggtgggcaatcattgttgtcttacctaagctctatcagaatatcgatttgaccggattactactgttagttgctggaggaatcgcttattctgtaggctcgctcttttatagtatgaaaaatagacgattcacccatgtaatctggcatttgtttgtcatgttaggtgcagcattgatgttttttgcgatttacgtaagtaattaagacgttgtgcatgatgaaataagaatgaacaaattgttgggacataggttcgttacactctcaaaaaaatagaagcactcgaaaatggtttatttttcgagtgcttcttgtttgaaaagggaatgcgaggaaatcctttatgactaaagcaaaaacgtgccgagcaatttagctcagcacgtttttttaccttattcttctactattttagctgatgcaggcaagcagtggttgacggcaatcgcaacggccatcccaatgaaactatcgatcacccggttaaaggcataaagataggattcagtttggggaaccataaataaaatcgtcaaaagggtagcacaggcaccgaccgttccttcgtgatagtcgaatttcactaataatgcgatcatcagcatgataacgaaaggaatcgatagcagctgaacaaggtgtgtgtagccaaaaaatttaaaaattccgatacagatgatcgatgctaatgcgccaaaggtatttccagcaatccgatgccggccgtatttgacagtagtcccatgatcttctcttaaggtaaagacagcggtgatcgttgaaacaacgtatgtctcacgctgtagaagaaaacttagaagaatacaaatgaagacgctgatccccgtttttagatttcgcaaaccaaattttaatccgaatagattcaataatgccatcctttcataagaaatcatcttaaccctttcaaacgaatcatatcataccataagctgtatttgctagtgaaaaaaaagtccgaaaggttgctgcaaaggcttttctttgtgaaaaaccttcgtggctctcctggagaatacgtcaatcagcttgagagtgatcaaaaaagagtgaataccatcgttggagcgaatcagttgcttggctgaccaaacaagcgtaacataatattgtaaacgttatcttattggagagcagggatagggatggaaaaaatttatcaagcaagtacggcagaaggcgcagtcgattttatcaacatgcgtgatttagaagaggcagcaaaagaagtgattcccaaaggaggctatggctacatctctagcggtgcgggagataccttcacttatcgagaaaatgaacgcgcattcaatcataagctgattattcctcatgtcctcaaagacattgaattaccagacaccaggactaatttttccggtgatacattaaatgcaccgattatcatggctccggtggccgctcatggcttggccaatgtcaatgcggagaaagcctcggcaaaaggagttgcgcgcttcggtacaatttacacagctagttcttatgcttcctgtacgctagaagaaattcgggcagccggcggagaacaagcacctcagtggtttcaattctatatgagcaaagatgatggcatcaatcgggatattttggcgatggcgaaacgcaatggtgccaaagcgattgttttaacggcggatgccacagttggtggcaaccgagaaacggatcgccgtaacggctttacctttccattggctatgccaattgtgcaagcttatcagtctggaatcggacaaacaatggatgcggtatatggctcctccaaacaaaaactgagtcctcaagatgtggcgttcattgcgaaggaatctgacttacctgtttatgtcaaaggggttcaatcagaagaagatgtagcacgtgcgttagatgctggagcacaagggatttgggtctcaaatcatggtggccgtcagttagatggtggaccagctgcttttgattctttacagatcgtagcagatgccgtcgctggcagagttccgatcgtctttgacagcggtgttcgccgtgggcagcacgtctttaaagcaatcgcctctggtgctgatctagtggcgattggacgtccagtgatttacggattagcgttaggcggttcaacaggcgttcagcaagtgttcgatttcttcaaaaaagaattagagatggtaatgcaattagcagggactcaaacgattgcagatattcgccaagcgaaactacgggacaatcattatatgtaataaaaaatagtaataaaaagagccttcctctgccgcacgcagccagaaattcaaagaactgaaacctttgaaagccacggcagcggggctttttttatggcttttttgtatctgggttgattataggaaatcaccggtatcaagaacgaactgctacgatttatttgatagtaacagtgtatatgattttgaaaaggagagaaaaccctgtacacttaaattaacgaaatcaaaaaggagagggtaaaatgattccaaaaatcattcattattgctggtttgggggcaatgaattaggggaaagcgaacagaaatatatcgaaacctggcgcaaattttgcccagactatgagatcaaacgctgggatgaatcaacgatcgatctttcaaaatttggttcttacttacaagaagcctacaaacaagaagaatgggcctttgtttctgacgttgttcgtttgtatgcattagtgacagaaggcggcatttatatggataccgatgtcgaagtggtgaaaccattagatgatctattaaactatgaggcatttatgggatttgagatcgaaaccaaaatttccaccggtatcatcggtgcagtgcctcatcatcctttcatggaagaatggtatcatgactatgatgatcgtgaatttgtgcgagcagaaaaaacggaagatgtagtaaccaacgtcattcgagtcactgaattgttgcaggaatatggtctgcaactaaacaatcagcgtcaaacggttaaaggggtagaaattttcccgcaaatgactttctctccaaaaagttatattaccggcgaagttgaggaagatccaactactatggtgatccaccaattttccggatcttggctataaacagttttttactgatccgatagttcgtcaagcagaatcccagcaacagttgaatgggcgcctgctgacgaactattttttattgtctttggcaatgaattatgccacaatagaacgaaatgaaatggatcggagtgagagtttatcatgggaattatccaatgtacaccggctgaccttgttgagttgaaagccatcagtattgagacgtatcaggacacatttgcgccatataatacggaagaaaatatgcaagcttatttagaggctgcttatcattcagaaaagttgcacaaagaactgaaaaatccgcagtctgcttttttctttttgcaagaagaagcaattgctggttatctaaagcttaattggggaacagctcaaactgagccgattgcaccagagggacttgaagttgagcggatctacatccgaagtgactacaaacgccgcggctatggtcagcaattgttgtcttttgcggaagagtttgccaaggcaaaacaaaagacgtctttgtggttaggcgtatgggaacacaatgccaatgcattggctttttataacaagatgggctttcgacgagtaggcagtcattctttcttcatgggggatgatgaacagaccgattatttaatggaaaaacaaatatgaagagagtcactcttcttcgattcgttgttgttgaaaaatcaaagtcgaaaacctgtcgatgagagatgccattagtgacttcgaaagagggagcaagaggaggatgaaaattccttttcaattaatagagcttccagtatagtagtaaatgactaactaaaaaatgaaaattatggtgacagatgaaggagacaagaatgggacaacaaaaaactgaaagtgtattatcacgatttttaaaaggagtcgttattgctttaggatttattttgccgggggtctccggtggagttctagcagcaattttagggatctatgaacgaatgctgcgttttatggcacatttaacgaaaaacttcaaagaaaatctgctctttttcttgccagtagggatcggcgggatcgttgggatcgggcttttatcgaaaccgttagaatggctgctgcaaaattatcagattgtcgtcttatggggatttgccggagccattattggtacattgcctgcacttgcaaaagaatcgactcttaaaagcaaacgaactatgggggatttgttttggttctttggtacaatgatcatcggtttcttatttctttatttcatgggtgatattctaggaacgatcccagcaaactttttaggatttgttttggccggcggattgattgcattaggtgtgttggtgcctggattaagcccatctaacttattgctcgtattaggtttgtatgatccgatgttgaaaggcttcaaggggttcgacattttaggcgtcttcttgccgatcgcaattggtggtctactcgtgatgctgctgttctcaaaattgatggagtggctcttggagcattatcattcgaaagtctatcactttattttgggaattgtgattgcatcaacagtattaatcgtcttgccaccagtggctgattatagcggatttacttggctgactgcggtcagcggtgtgatactgtttgttttagggtactggttaggggcttggatgagtaaattagaagaaaaatataaataaccactgcgtggataaaaaaacaatcggtcagatgatcgattgtttttttatggaatagaaaccgaggcaacctttgtctgaatagcgacgttcacacgtactatcctcactcccccttggaagataatcatgaaacgtcgctggaaaaaggggacaggatcgaacgggacaacttacatctgatcgctaagcgcccaaatttaaaaaaggatatatatataaaagaggtatcggacgatcctgcccaatacctttgtcatagtgaaataagcagaccaaagcgtgttgatttacctaaaaagaggtagaaatcacccagaaaattgggtacaataaacacgttgatgtactgcattgactatggcaaacttgatggtcagttgctgctgacaaatcaaggccctattccttagttgccgctaagggatggggtgccttttttggtttctattcgcttttattttatagaaagcgagggtataaatcaagggaacgtttccatatttaatgaaaaaatgcaagtgttttattagaaaaacgtgaaaagataacagaattctgtgagatttgtcaataaaagtcaatatttatttattgatatgagaaagactgaaaaaataaattttttcctgggagagccaagccatcaaagtgatgatttggctcttttttgtcgcttttttaaggggggcacttacgagtcctttattgtgttaggcgcaaaagtttaccaacttaacatgaacttttcataacgcttactggatgttaacgattgcttgataggatggagtaaatgagtaatgaggtgaaaagatgaatcatgataggctaaaggtacttattgaaaagagactgccccatatccctgcaagggattgtaaacgaaacacctccaaaagcaaacggattttggatcctcaaaaaagtatccggttccaacgtggacttgctaagaaaaagatgctaaatgggctagctataatagtaattaggaaatggcttttgagaatcagcaaagaccgacagatgggggtgacaagctatgtccattaaatcgcaaataaccgaaaagctgcttttactggttttggatggctgccgatacgataccgcggttgaacagatggggatcttgaatcatcatgtggattataaacaagcacaactgatcaaagtccatgctgaaatgcctagcagttctcggccattgtatgaagtgttggctactggtgtaccaagctaccggaatgggattctgaccaatgctgatggtcaacattccaaagaactctcgatttttgatcttgtcaaagctgccggcggaagtactgcagctgcagcacattattggcaaagtgaattattcaatcaagcaccttatgaaatcaaacgagatcgtattcaacacgaccacaaaaaaagtatccaacatggaatcttttatagtgaaaaccagtatcccgattcacatgtgttttcagatggacattatttactgcacacgtatcagccgaatttgttactgatacattccatgaatatcgatgccgcgggacatcgttatacggctgtttcaaaagaataccgaaaagccgtaaaccaagcagaccaattgattggcctgtatttgcacgattggttggctgcaggttatcaagtgattgttactgcggaccacgggatggatgaatatgggttgcatggcggaagcatggctgctcatcgcgaagtccccctctatattttttcagatatttttccgccagactgtgggatcgaaaaaatgaatcaattagagttggcaccactgatttgcagtttattaaaaatcgatacttctgaacgcatgcagattgggcgcagctgatttgtagaaacgaacaaagccgctaaagtcaggtgctcaaattagggcatcattgctagaggtctatttggtttggcttaacgggcataaatagatggcttatatcagatgaataagcaaaaaagtaatcgattgttgttccgctacagagaactgtgccatgagtgaaaataaacggacattgtaaatgagagaaagtggctgccgcgtcttggaaactgtgagagtgcctaggtactatagcagcagttgcgatcgttagaatttattgggttttgtttagatccggtcgttccgtctgtttgttgactgtttatgggaccgtcttttttaattagaacaaggcaacgaagtgctgctattctttgcacttttagacaaacgactttatttgtctaaatctgtgaaaaatagcggttgttatttttgtcacaaatagaagatactgctaccatggatttgtaccaatattaggaggggatcatatgagatatacaaacggaaattatgaagcttttgcaagaagcagaaaaccgaaagatgtcgaaaagaaacaggcctatattgttggtggcggattagctggattagcagcagcagtctttttgattcgtgacggacacatggagggaaagaaaatccatgtgctggaggagctgtctctttcaggcggctcactcgacggcaaatttattcctcatgatggctttgtcactcgaggcggccgtgaaatggaaaatcattttgaatgtttatgggatttattccgttcgattccatcattggaggtagaagatgcttccgtcttagatgaattttattggttggatcatgacgatccaaactcatccaattgtcggatcattcatgatcgtggccaacgagcagcagatgacggagaattcactttatcagcagcagcccaaaaagagttggtccaactatttatgacttcagaagatcagcttgttggcaaacggatcgaggatgtttttggagacgagttctttgaatcaaacttttggctttattggtgtacgatgtttgcttttgaaaaatggcattctgccatcgaaatgcgtagatatgttttaagattcattcaccatatcgatggattgcctgatttcacggctttgaaatttactcgttacaatcaatatgaatcgttagttaaaccattattagcttaccttgatgcacaaggtgtcgatttccaatatgaaaccaaagtcatgaatattgacgtgaagatcactgaaggagagaaaatcgcccaaagtatcacactgatgaaaaatggcaaagcccaagaaatcactttgacagcagatgatctggtgtttgtaacaaacggctcaatcacggagagttcgactgaaggggatcaccatacacctgcccctattactcatgaattaggtggcagttggaatctttggaagaacttggctgctcaatctcctgaatttggtcgcccagaagtcttttatgacaatctgccagcagaaagctggtttgtatcagcgacagtcacatggcaaaactttgatattgaaccttatatttctcgtttgacaaaacggaaattacggacaggaagagtagtgaccggtgggatcgtcactatcaaagattcaaattggctgatgagttttgcgacccatcgtcaacctcatttcaaagagcaaggcgatcaacaaacggtgacttgggtttatggtctattgtctaatacaccaggaaattatatcaaaaaaccgattgaacactgttccggacaagaaatcgttcaagaactattgtatcacttaggtgttccagaagatgaaattctacggatctctaatgaatcatgttcagcgatccctgtgtatatgcctttcatcacttcttacttcatgttgcgggaacctggagatcgtccgcttgtgataccgaatggttcacgaaacttagccttcatcggcaactttgccgaaacgcaacgtgataccgtctttacgactgaatattctgtacgaacggcgatggaagctgtctaccaattgttagctattgaacgaggcgttccagaagtctttgcttccgcctatgatctgcgtacattggccaatgcgatttactatttatcggacaagaaaaaattgactgagatggagctgccatttatcgaacgcaaattagtagaaggatttgttaagaagacgaaagatacctatatcggcgaaatccttgaaaaaaatcatttagtttaacacacttgaatgctgtgacatccgttacttaaagacaggatacccgaaagaaccagagaggccattaaacggcctctcttttcttcgaggttacgtatgtctgacggatggcactgtttttttgggaacgatttccatgctgtagacccccctgtgtgatgtacacaagagtagcgaaaaataagggaaccgctatcaaacaaattgcttctttttaataatacagagtgttattctgttatatttctattgaactttttcactctgtttggtatattggttgttaattaaaagctttttttgcttttagtacagaagctataattgttacgatgaaaggcgggagatttatggaagatgcgacctattgggcagagcaattaacgcagaagaaaatcagtttttcggaattgacagctaggatcgaagaaaaaattcagcaagttgagccaacgttaaatgcgcttgtttcttttgatcggcaagcagcaattaagcagtatgaacaaaatccgcaaacaaaagcggctttattcagcgggctgccaataccacttaaaatattgggtcaaagtaaagcggggtggccggccacatcggcggctgcattgtttgcaaatgcaaaagcagagcagacgagtgcatttgtcaacgggctggaacagctaggattgattcctttgggacaaaccaatgctccggaatttggtttcaaaaatgttaccgatccagtattgtacggtccaacacgcaatccgtggcagtccgcctattcggcagggggatccagcggtggagcggcggccgtcgtagcggctggactatttccattagctgctgctagtgatggaggcggttccattcgtatcccagcttctttcaacggactaattgggttaaaaccgacgcgaggaactatgccagtgggacctcaagaatggcgtagttggcaaggtgcttcgatcaattttgcattgacgctttctatgagagatacggaacgtttgttttatggattacgaacgtctcaaccggcggctccctatcaggcacctagaatcgaatggaaacatcatggacccagtcagaatcgaacactgagagttgcgtacacaaccgagtctccagccgggagtccagtttcacaaactgctgtcttagctgtcaagaaagctgtcgcatttttggaagatcaaggacatcaggttacagaaatccgttatcctgttgacggtcaaacgatgatggcaagctattatcgtatgaatggtggagagacagcagcaatgtttgccgagatcgaggcaatgctgcaacgaccagtggaacagaaagatatggagctgatgacttgggggctgtaccaatatggcaaaaaattagcggctgccgattatatccaggcattgcaatattgggatcagctggcagtaacgatggaagctttgtttgcagattatgagttgtttttgacccctgcaacagcacaaacggcgccattgattgaagaggatttgcaaagtgatacgattcgaagcgaactgcaagagatagaaagacgaacagctgctgctgccggagacttgatttatcagatgttcgacaaaagtttggcactgacgccctatacgcaattggccaatctaacgggccaacctgcaatcagccttccaacagctgttagtgaggaaggtttgccattgggaattcagtttatggcatcaaaaggccgtgaagatttactttttcaagtgggtgaattgtttgaacgatgggagcaatttcatttacccaaaaaataactgtcgatgaatgacggttcaagaatgattttctagggggataaagatggaaacaatcaaaataaacaagtggaaaaatatcgttgtactaggtgcctttgtgatgttgttaggtgcttgcggaagtaaggctaaagaggacaatagtttaagtcgtgttcaagagtcaaaagaattgactgttgctacgtcaggtacgttatttccttcctcttattacaatgatgacaatcaattagttggctatgacgtagacgttgcaaaagaagtagccaagcggatgggtgtttcgatccagttcaaagaatacaatgtagacggacaagtggcgtccttgactagaggtgaagcggactttgccgcaaatgatttcggtctcagcggagaccgtggagataagtttcgtctgtctgaaccaatcaagtattcatttgatagtatgatcgtgcgaaaaagcgatgattctggcattgcctctctagatgatttagcaggcaaaaaagcagcgggagaacccaatacaagctacatgaagttagccgaagaatatggtgcgaaacttgtgacctatgataatgccacgaatgaccagtatctgacagatgtggcaaacggacggaccgatgtgatccttaatgattattatctgcaaaagatgtcggtggcagctttgccagatattccagttaaaatcttggaagatgtctacttcaatccgaacgaaacaggctttctttttgcgaaagacaaccaagcactgcatgacgaagtcgatcgtgttttaaaagagatgaaagcagacgggacgttaaaagaaatttccgaaaaatacttccaaacagatgtatctgtaccatctgacaaagagatccaaaaggttgaaaagtaatgtatatcccaactcttgatcttccactgatgtgggagtcgcttccttttttactgacagggttatcctatacgttagggattgccattgcttcttttctcgcaggaaatgcgttaggtttattgctgacttttctggggatgcttcaaaacccttgggtaagaaggatcgttcgaggctatatctcctttctgcgaggagtacccgcattggtgctgttgtttttgctctatttcggattgccgtatcaattacccgcattgacagctgccattatttgttttagtttgactagcagtgcttttattggagaaatttatcgaggatcgatcgccggagtggatcgcgggcaatgggatgcagcgtatgctctgggattgagtttttctaaaacattacggttgatcattctgcctcaggcatttcgcatatcggtcccagcattaagcaatgtcgcgatggacctgttgaaaggaacctcgttagcggcaatgatcacgatcccggacatttttcaaaaagccaaaattgttggcggccggacgtttgattatatgtcgatgtacgtgttagtggcgatcatttactggttgctgtgtatcgggatcgaagcgctccaacatcgcttagaaaaacgatttgctgaccgctttgaaagtcaaaaaggctgatcgtcaaaaaagctgatcgtcaaaaaagtagctaaaaaaattcgctggttggattatttatgaatcaatctctttgtttgtggtacactttacaaaaaaggagtttggacaatgaaatatgaatggcgaaaacaagaaaaagcttactatttaccaaaagaaccacagctgatcgaagtgcctgcttatcaattcattacgttgactggcgaaggaaaccctaaccgtcctgaattttccgagcaaatcagtgcactttatatgatggcctatggattgcgcatgggattgaaaaaaggctccttcggcaatacgccttttgagtatacggtatacccgctagaaggcgtatggactttacctgaaaaaccacaaggaccgattgctaaagaagagttgatctataaaatcatgattcggcaaccggaacaagtaactgctgatttagccgccgaacagttgacacaaatcatgaagaaaaaagaaaatcgttttttggaacgaattcgtttcgaagaataccaagaaggctggtccgtgcaagcttgtcacatcggtccttttgacacagaaacagaaacgtttgcgaaaatgcaagactattgcgaagcccacgatctatcaattgttcccacgatgggcaattatcagcatcgggagatctatctgtcagatccgcgaaagacagcaccagaaaaagcaaaaacagtcttacgctggcgggtagccaaaacaaacaaagaatccgcttgatccatttaaccgttggtgtacttaatgaaaacacgtaatgaaaagagagagaaccgcgcttaagcgattctctctcttttactactcatcttttaagtagtcttcactggtgaattcactgtgaaaatacttgccttcgtcgccgtaataggtattgtaccgttgcttgaatttgcggaatccatacaccactaatacttttaagagacagtagatcggtattccgaaaatgacacctacgatccccatcaaatcccccataactaataaaacaacgagaatcgtgatcggatggatctgcagacgatctcccattacacgaggaacgaccaagtcaccatgaagcagctgtacggcgaaccaagcaatcaggaatttgatcagcattcctgttgaatcttgtgctgcgatgaaaagggccgggaagaagacgataaatggaccgatatatggaatgatacataaaattccggcagcgatcgccaagatacttgcatattctaaaccaatcagcaaaaaaatcacccaataaattccgcctaaaataaaggaagaaataatctgtcctttcagaaaggcaccaacttgtaggtcagcgatctttacgatcgtgttgaaatctttacgaaatcgcggtggtacgattgacaggagagaataataaaacttgtttggatttcttagtaagaaaaaagcaatgatcggacctgtaaacaatgcgataaacaacgttgagatcgtcgaaaagatactgctaagccctgcagcaccggtttgccaatagtcaccaatgaaatccatgatattgttggcaactttttgaagagtatccgtgatctgatcgatctgagcaccaaatggcgtattcgctaggaatgagtcagcgtttcgctcgaaatcagcaatcaaatctgggaattgattgatcaaatcggttgtttgtttttggatgattggataaagctgaaacccagccaaaacgatcactaaaagaatcagaagatagatcccgccaatggaaacaatgcggggaatctttttcgtttctaagcgatcaactaacggattgaacaaataatacaagatcaggccgaataaaaatggtggaataagagtagaaataatgacaaaaaaaggatcaaaaagaaacgagatttgtttaagtaaaaaagcagcgatcgcacagagaatgatcaatcccagtacataatagctggtttttcctcctaaaaattggattaaacggttttttttcatagaagagcctcactttcttagcctcattataacgaaagcagcactttctgtaaaaaaagagcgagtcaaaccaattttattttttacttttgcttatttgattcgtttatagatatgtaagggcgccacttacgaagcaatcaaaatacaatagaggaggaaaagaagcgatgaagaccaaaaccaccacaaggctgacgattcgaatccaagcaccagatgcagaaaaaactgtcagtcagaccgtcaatcaagtcatgaatgctccagaggaggctaagatgttagcgtttggtgaagccatggcaggattttctaagaatgcgtctttggctggcgtggtagaaacgatccagaatgagtacgtaaaataacgaaaggagagaaagcgatgaaaaagcttcatgcattatttttgactagcgagggcaaaaaacacacattgcagccaaaagtttttgatgaagagataacggcagaagcagcacgaacagcaatggagaatattacaaaaatcggtatctttgaatcagatggtgtccgttattacaatgagctgtctggcgccaaaatcgtagagacgattgagacgccattgttttgaaataagttgaagtagaacgttcatcaagaaatgctcgacaatcaaaagggactgtgccataagtcagtatccaacaagttaaaccgaataatagtctgttgctagcatagattcctctgacttttgcgacgaggagtccctgcaccgcaggagcaataatcattaatgttcggctagtgttacttgtaggagacttatggcacagtccctttatttggtgacggcagttaatgtacaacgtccgacagccgttttcgtgccatcggattgtctgatcgtagcttgccaagtttggatctttccaccgattcgatcagggacagcttccacagtaacagttccttgtttgaccgcttttaaatgattgacttgtagatcaatcgcggcggcaaattggtcttcagctacggcttgatttgcccccagactacaagctgtttcaatcaagacggcattgataccaccgtgcagaagaccaaaaggttgtttatgctgatcggtgaccactaaagataaccgaacctgagtagcggttgtttcttcgatctggatgcctaaatagtcaagtaagttcatagagttcctcgttttctgagaatttgatgatttgattataacaaacgtttgacagaaagcaatttctaacgaaattcgctcagaaatgtgtataatggaaacatgtgacataaggaggaacctgtaatgagagaatggaaaaccttaaaagaatacgatgaaattttatttgaacatcatggtaaagtggcgaagatcacgatcaatcgtccagaagtccacaatgcctttacaccgaaaacggtgtttgaaatgatcgatgctttttcaatcagtcgcgatgaacctggcattggggtgatcattctaacaggagctggcgacaaagctttttgttctggcggcgaccaaaaagttcgcggacatggcggctatgttggtgaagatcaagttcctcgtctcaatgtgctggacttgcaacgtttgatccggacattaccaaaaccggtgatcgctatggtcaaaggttggtctattggaggcggaaacgtgctgcagctggtttgtgatctaacgatcgcggcagataatgcgaaatttggtcaaacaggaccgaatgtcggcagtttcgatggtggctacggttcaggctatcttgctcgaacgattggccacaagaaagccaaagaagtttggtttatgacgaaacagtatacagcagaagaagctttagcaatgaactggatcaatacagtcgttcctcttgatcaagtggaagatgtgacgatggaatgggcagaaacgatgctgcaaaaaagcccattggctttgcgcatgatcaaagcctcaatgaatgccgatacagatgggctagccggaatccaacaacttgctggcgatgcgaccttattgtattacacaatggatgaagcaaaagaaggccgcgatgcgtttaaagaaaaacgtcagcctaatttcgaccaattccctaaattcccttaatgaatggtagttggctgcaacggcaagcacaacttcatccagaacgaccagctttttattggcaagataaaagctggtcgtttgctgccttgcaaaaagaagtcacggcttatgcttgctattatgaacatcggattcctcaaacaatcgagcgagtagcgattttaagcaataactctcctgagatgtatttcacgattttggcactttgggaattaggaaaacaaattcagttcttaaacactcgattgactgaaaaagagctgtactatcaattaaccgatgctgcctgtcagtgggtagtcaccaatcgatcgctttccttgccgagaatcaagttcctgccttttggcaaattgcaagaacgttttttttctgcgccgatttcgatttaccaaaaaacacaagttgcatcgatcatgtacacttctggcacgacgggtaatcccaaaggagtgcctcaaacatttggcaatcattttgccagtgcacaagccacgcagatcaacttgtcggtgactgctgacgactgctggtgttgtgtcgttccgttgtatcatattagcggtttatcaattttgttgcgttccttgattttagggatcagtgttcgattatatgatcgattcgatgcgcagcaaatcgcatcagacctagctgctggtaaaggaacggtgctctcgttagtgaccaaaatgctgatcgatcttttgcctttgactggagacaatggttacccttcattgcgctatattcttttaggtggtggtccgattgccagatcagtcttgatgcaatgccaagacaagtgcttatcagttattcaatcctatgggatgactgaaacttgttcgcaagtcgttgctttgcctccagataaagccgaggaaaaaattggttctgctggattaccattagcccaagtcaatttgcggattcagtcgcagtctttgaaagaatctgttatcgaaaaagaaggaaaactgggggaaatccagttgcaaggacctgcgatcgttacgtgctatttgaatgatcgcgggttggagcagtggacgcaggatggctggtttgccaccggtgatcttggctatttggattctgaagggtatttgtatgtggtatctcgtttgagcgaattgattatttccggtggcgaaaatatttatccagctgaagttgaacaggcattagttagccaccctgcaattgaagaagcggcagtggtgggcgagccaagtggagtgtggggacaagagccagttgcttatcttacactcaaagagccgattacattaccagaattgatcgcctatctaaccccacagcttgctcggtacaaacacccccgtcgctattatcaagtaaaagaaatgccgcgtaccgctagcgggaaaatagtaaagcgtgtattgctgacagaagaaagagtgaactacattgaacagcaaatcaaagaatgagtatcaacatgcattagctgctggcaaaaaggtgtttagtcattattacccacttgcaccttgtgattttgttcagttatatgctgctgccagtcaatttattggtgaacgttatttttggcgatcatcagatcaagcaacctgttttttgggtatcggcagtgtgaaacggtacgcgaacccatcattgattgattttgagcggcagcgtcgaaaccttaaaaagcagcattttcaaccaaatacggaccaaatggctgctacattattaggggcttttgcttttgatgaacaaagccaaggagcagcagaatggggcacaatcggcaatggtctttttgtgttgccgaaaattctttttagaaaaataaatgatgtgtatggtgtgatcttgaccgtcgaagcgaaggatacgaatgacgtggaaacgctgttcggacagtttgctgatttacaacaactcgttgagcaatggggaaagcaagcacaacagcctgtaggggcttgtttgttgcagcaaacagaattagacgtaccacaatgggtaaaagcggtcgatgagacagtcgctgcgatccgctctgcaaaaacgcctttggagaaggttgttttagctcggcgaatgaaaatcactactaagaaggagattgattcctttgcggtgttggcccgtcttgcagagcaacaaaccaatacctatctctttgcttttgaagacgaggtttcgtttattggtgccacaccggagcgcttgttaaaggcgactgccagtcatttcgagacagtcagcattgcagggtctgcgcctcgaggcagcacaccagcagaagatcagcaaatagctgatgcattattaactgatcccaaaaatacccatgagcatcaagtagttgtcaatcgtctggagcaggcgttgtcttccttattggcggaagggttccattcagaggcgcgatcgatcatcaagaatcgcgacattcagcacttattcgtgcctttgtctggcaagcggaagcccgctgtttcttttttagaagcagtggctaagctgcatccaacaccagccctaggtggggagccaaaagctgatgcgctggcatggattcgtaaccacgaacctgcgcgtcggggattatatggtggaccaatcgggtggctaggtatccaagaagatatcggagaatttgcagtagcgattcgttctggtgtttttcatgggacagaaggcatcctttacgcaggatgcgggatcgtcgccgattctgttgcagaagaagagcgccaagagacagccttgaaattccaacctatgctaagaggagtgatagagaatgaatcagcaagtcatgactgactacttgttggcagcaatccatgggtttaaagccgctggaataaagcgagcggtgatcagtcccggatcgcggtcgacaccgttggcattgcttttgcatcgggatccagaaatcacttgttggatcgatgtcgatgaacgttcagcagctttttttgcgttgggaatgaccaaagtcgatttgcagccgacacttttactatgtacatcaggtactgctgcagccaattactatccagcaatttgtgaggcggaagccacaaattttccattgatcgtcttaactgctgatcggccaccggaactacgtggtgttggtgcaccgcaagccatggatcagcaaagtctgtatgcttctcatgtaaaaaaaatggtagaaatgactgtgccggagaatacacccaacatactgaagtacagcttttggcaggctgccacgacaacgatcgaagcattaaagcagccacgtggtcccgtacacctgaattttcctttgcgggaaccattactgcctgacttcacgcggacttgttcgatccaacaaaatatcgcttacctccctacacagcaatcgctacctgcagctgtattgacagaactggcaccattgtttatgaaaaaagggctcctagtggtaggtgaaagtttgacaccttctgaagcagaaacgctgcatgcgcttgccaatcatcttggctggcctctagtgggggatccactgacaaatttggccacttgcggggaaacgtcggctcattttctcccacaggctgatttgatttttccacaactagatgcggactttattcccgaagtcgttattcgttttggtcgcttgccagtgaccaaaaatgtcttgctttggttaagcggtctgccggaaggcatcgactggcttttcgtggatgaatctggacagtggcaagatcaattgcatcgctcagcctttttgctacagcttacgatagaggattttgtggagcaagtaagcaagttgcctagcagaccacaaccagaatggtttcagccatggcaaaagctgcaagccgtcgctgaggaagcattggcaacgactcattctttaacggagtggaatgaaactgctgctgtacggatcttgcaacaaacattgggacatgatgcccaattgctcttagcaaatagtaatgcgatccgctttgttgatcgatacggaacggttacaggtagtgcttaccaagtatttggcaatcgcggtgtgaatggtatcgatgggttgatatcgaccgttgctgggatcgcagctgccagccaaaaaccgacctatttattgattggcgatctagctttctttcatgatatgaatgggctgcaattgctcaaacaatatcagctgccagtcacgatcattttactgaataataacggtggggggattttttccttcttatcgcaaaataccttgtcagaaagtgactttgtgccgctatttggcaccccgttggatcttgactttcagcaagctgcaaaactttatggcgcgaaatggcacgctccagcaactttgactgattttgcctcccaaatcgagcaatcattaacgacgccttgttttcagatcattgaagtagttggcctgcaaaaagatcctgtgatcgcttggcaagcgttgcaacaggagtttcaggaaaggatctccaatgaaaataaacgttaacggtgtgaactatttgtatcagtggtatcgaccttatctggctgatctgccgaccctcgtagttctgcacggatttactggcacttcagattcttttcgcccagtgtttgctcaagaaacgtccttcaatgtcttagcaatcgatttgttgggtcatggtggttccgccagtcatgtgcacccgttacgctatgagatgattcagatggtaacggatctggcagaattggtggatcgtttaacggttgaccgttattatctttatggctattcaatgggtgctcgtacggcattggcatggacggttgctttcccagacaagatcgctggcttgatcatggagagcggctctccgggactggaatcagaatctgcccgcagtcttcgccgacgcaatgatcaacgtttggcgatacgattgattcagcaaccgctggttgactttgttgattattggcaagaactgccattgtttgctagtcaaaaacgattaccaaaggaaatacagcagcaagtacgagcgacgcgtttgagccaacaggcgtttggtttggcgatgagtttgtactatagcggaacaggaacacaacctagcttctggcaaaatttggcagacattcagtgcccatttctggttctcactggagaatgggatgaaaaatttttcctgatcgctaaaaaaatgcagcagcaacaaccagcgttgactatcctctcggtgtcaaaagccggtcattgcgtgcatttggaatgtccagatgtagtggcaaatgaagtgcatgcttggttgaccgcacactgatattggaaaaggagagcgcgtatgaaaatcgtcaaagcagaacggattgcttgtcgactcccgttgaggcagccttttgagacgagttatggtcgcttgacggaaaaagcatttgacctgcttgtactgaccgaccaagacggaaccgtaggtgttggagaattggtggcttttcagcaaccagattatattgaagaaacgttggcttcagctcgagaagtcattagcaagttcttattcccattgctgacaggaaacatcgatcatccgcgagatgtttggacgttatttcaaacagttcaaggaaattttatggccaaatcagcagttgaaacggcgatttgggatttatatggccgccaaaaacattgcagtctgacctctttttatccaacaacaagagacaagcttgctgtaggggtcagtgtggggattcaagcatccacagaacagctagtcgcacaagtcgctgattatgtagcgcaaggatatcagcgagtaaaaatcaaaatcaagccgggagtcgacttagagccgttgacagccgttcgggaaacctttcccgagctattgctgatggctgatgcgaacggcgcttatgaagatcaaccggaaaagattctcgcattagatgaattggggctggcaatgatcgagcaaccgttgaagatccgggatctagtggggcatcgccgtctgcagaagcagttaaagacgccgctatgtttagatgaagatatacgtactgcagaagatgtcgctgttgttgcctcattagatagttgccgagcaatcaatctaaaaattccgcgagtgggaggaatcaccgaagcgatgcgaattgtttcagcctgccaacattatggattggatgtctggctaggtggaatgttcgaatcaggagtgggacgagcgttgaatctgcagtttgccagccaagctcccttccacttccctggtgatctatctgcttctgatcgttatttttacgatgacatcgtcactgaacctgcgaagatcaaaaatggctgtcttcaggtgcctgttggtgtgggagcgggcttcacactagatgaaaagaaaatagctgactattgtgtttcccgtactcgtttgttaggttgaactttagaaatagtttttgatcagcagatcaattatcaagcagcaaaaagcaccttctcgcttttagagagggtgctttttgctgttatttggataaaagggcgtgcaagcgcctgttgctaagcctgttctttaaattctttctcaatttgcaaacggcgaactttcattgttgctgtacgagggatcttttcaaagtcccagagaattggctgattcaaacgaggaagatcttctactgcttgccaccaagctgtccaatccatttcacggtttggtgctaaggcaatgatcggttgcggtgaattttctttgtcacgaacgatgaccacttcagctagaaaatccaatgtatctaaaagcagatcttctaaagctaaattactatcgatggattcaatcagatccacttggcggtctttcaagaataaatgcccttcttcattcatgctgccataatcgccgctatcccaccaatctccataaacattctcagtaaaacgctgatcttctttataataagtcaatgcccgtcctttggataggaagtggatatgtccgtctgtatttgcaggcaactcattgccgtcagcatctgcgattcgtgctttggtcaaatcgcctaaaccaatccccatatcgcgagcatcatttgattgtatactttctagcgtatgtgctttcaggatcattgggccgcactcgctttggccgtatacttgcaagaagatggcatcttgattggcagaagtttgtaagaaagctgccattgtttgattattgatggcatcgaatgtggagtgataataccgtattccagcaaaagcttcaggatgttcttctgcaacgaatcgccattgcacgaagttatttgggtgtgtctctaaggcaatcggtggattctctttcaacatccgaacgacgtgaggaccattcgcactagcaagaggcatcattggaaagcccatagacatcaaagaagagatcccaatattgaagcgagaatgaaccggtgaaatatggaacgccactaattttgtttctgcgatttttgtgaagacagttcgctgccactttgtccgccaccccatagaattggccgagtgacaaatcaattttggtattcctgttgtgcctgaggtgtgggtcatataagaaatttgatcgtgaggcaattcggtttggccaacaggttcagctggttgcaacaatagattgcggacagcaatctgcttgttcgggctgctgtttttgacagctgccactcggttttctgtctcttcaccaaaaaggatataaggatcttctaagcggtcaacaaagacttcgatcgttgaagctggaaaatgataagaaatcattgctgggacagcgcctaaataagcagcagctgtagctaaaagatacgtatcaaattttgatgatttatagataatgattttatctccggcttggacgccaaggtgggcaagttgatacgcccgctttaagattatttcatgacttgaatgatatgtgctgcggtaacccaattcaggaaaagctggcaagatctcatcatgaatgattgggacgtctggataagcctccgccgcatcgcggtaattggtataaagattcaatggttgatacgctaaaatagacaaaataacacactcctttaaattgatgacggtgttttgttaacttcgatggttaataaagtcacctttctcaaactatggttcattttaacatagcgtttttttaagaatagttactttgggatttttttcacataacgtcttaaatcaactgacttacaagccgggtagggctattttgagacaatcaagtttgattagtgatactcgattggtatgttttgattggcacaagggcaaccgaggatagttagaacaaaagattctattgcgaacatcagcaggacgatagttgtcagtatgtctttttattgctatcatgaaaaaaaagacaaaggaagatcctgatggccaaaaagatacaaaataaaaaacatgtttcgcttcctcgataccagcagatcgctgtggagatcgcggaaagaatcgtggaaaatcgctacgaagttggacaaaaggttcatgcccgttcgacattagccagtaacttcaatgtgtcgccagaaacagcccgtaaagcaatcaatgtcttggtcgatttggggatcatggatgtccgtcatgggagcggcgcgtatattgcctcaaaagaaaaggcgcaatcttttttggatcagtacaaagatgttcaatcgatccaagagattcgtaaagacattttagaaagcgttgaacggcaacaacaagagctggataatttttcggaactattgaatgttttggttcggcaaacgaaaaaagtgcataatatgagcccttttctgccatttgaattgttattgaaagaagatgcccagcacttagagaaaagtgtccacgagctgaatatttggcaagtaacgggagcaaccatcgtggcaatccaaacggaacaagagttattgctctcaccaggcccttacgccaagtttagtgccggcaatacgatttattttgtcggaaatgagttggcactacaacgtatgacgaactttttttatccacaagactccgctaattgaagagcgaaagattccatttctaagaagagatggaatctttttttgacaaagtgaccacatgctgttagtatagtatggtcactttcgtgaaatttttcagaaaaaggagtcagtataagtgagtaaagttaaagttgcacatttaacgaaaatctttggcaagaagaagcaacaagcgtttgccatgattcaagaacaacgcagcaagaatgaaattctagaaaaaactggggccactgttggcgtctatgatgtgaattttgaagtcaatgaaggagaaatctttgtgattatgggactttctggtagtgggaagtcaaccttgatccgtttattgaatcggttgatcgaaccatccggtggagacatttatattgatggggaagacattgcgaagatgagtaaagaagaattacgtgaagtccgacgccataagatcaacatggttttccaaagctttggtttgttccctcaccgaacgattcttgagaatacagaatatggcttagaggtgcgaggggttcccaaagaagagcgagtagccaaagctgaaaaagctttagctaattctgggctattatctttcaaggatcaatatcctgatcaactgtctggtgggatgcaacaacgggttggtctggcgcgagcattagcaaatgatccagagatcttattgatggacgaagcattctctgcgttagatccgttgattcgtcgtgaaatgcaagatgagttgttagaattacaagccaatgtccaaaagacaattatttttatcactcatgatttgaatgaagccttgcgaattggtgatcgcatcgctttgatgaaagatgggcaaatcatgcaaattgggacaggagaagagattctgaccaatcctgcgaaccaatatgtgagagatttcgtcgaagatgtcgatcgctcgaaagttttgacggctcaaaacatcatggtaccagcactaacgacaaatatcgaaatcgatgggccaagcgttgcgctaaatcgaatgcgtaaagaggaagttagtatgttgctggcggtagacaaaaaacgtcatctaaaaggtagtttgacagccgagtcggctcgcgaagcacgcaaaaacaatttgaccctaaaagaagtcatcgataaaaatgtacaaaaaatcgacaaagatatgctagtgacggatattttcaatttaatttatgattccccgacaccgttagcggtggttgaaaatgatcgtctgatcggtgtagttattcgaggcagtgtgatcgaagcactggcagaaacggattcatcagtgacagaggaaggagtggtcgtcaatgggtaattttcttcaacaaacgattccagttgctgattgggtagagtcctttacagattggctaacaggaacttttagtgggctcttttccgcattgcagtcttttggtcagttcgtgatggatggaatgactaatactttgctttttgtgccaccactagtcatgatcttgctgctgacaatcgctgcattttttgtttcaagtaaaaaatgggggttgacggcatttacatttgtcgggctactgtttatctacaatcaaggtttgtggactgatttgatgaatactgtcacattggttctgctctctagtctggtatcgatcattatcggtattcccctcggaatcttaatggcaaaaagcgaaaaggcgcaaagcatcgttacgccaatcttagatttcatgcaaacgatgcctggcttcgtctatctgatcccagcagtcgctttctttgggatcggcatggtaccaggggtttttgcctcagtgatttttgcattgccgccgactgtacggatgactaatttaggaatccgtcaaatttctcgtgaattagtcgaagcttcggattcctttgggggaactggctggcagaaattggtcaagttagaattgccattagcgaaaagtacgattttagcaggtgtcaatcaaaccacgatgcttgctctttcaatggtagtgattgcttcgatgatcggtgcccctggtcttggacgaggtgtcctatctgcactgcagcgggcacaagtcggaaatggatttgtgagtggggtttcattagtgatcttagcgatcattatggatcggtttacccaaaacttgaataaacccgctcataagaaaaaagccgtgtccgcgaaaagccgcaagcaaaaacgtctctttggcgggatcgctgccgcagctgttgttgcgctgattggtgcttctgtagcttttggtcgtgtttcagacaataaaggaacagtcaacttagcatatgtcgaatgggatacagaagtggcttccactcatgtggtagctgaagtgttaaaagaaatgggctatgaagtcaagacgacaccattagacaatgcgatcatgtgggaatctgtggctaaaggcgaagttgacgggatggtagctgcctggttgccttcgactcaccaagctcaatatgaacaatataaagaccaagtagaaaatctaggaccaaacttagagggagctaaactgggaattgcagttcctagctacatggcagttgactctatcgcagatctatcggatgaggcaggaaaaacgatcacgggaattgaaccaggtgcaggtgtggtcgctgctgctgaaaatacagttgcaacatatgataatctttctgattggaatgtggcgacatcttcttccggggcaatgactgtggcgttaggacaagccatcaagaataaagaagacattgtgatcactggctggtcgcctcactggatgtttgcaaaatatgatttgaaatatctagatgatcctgaaggaacgatgggagaagcagagagtatcaatacgatggtacgccaaggattagctgatgatctgccagaagtttatgaagtactggataaattcaattggacacaagaagatatggaagaagtcatgctgtcaatcaacgatggaacttctgctgaagatgctgcaaaagattgggtaaccaatcacccagaagaagtggcagcttggacgaagtaagtcaatgaagcatgaaaggatcagataaataaacaaaaaaagaaagtttcgcatctagactcggtggccgagttcaggtgtgagactttcgtttttttcactatctactgactgtctactgatagtagccagcaattttttgtgctttttcagtattggcgaaatgcagtttggtatacttcgctaataaaggcattccgcctttttgcaaaagctgagcagcgacctgatcggatttgctgccggcacccgaaggaagctgtaatccaacttcttgtgaggccttctctagttcctccagaaaaacagtgcggcatagaatggaggccgcagccactgctaaatgatattgctccccttttgttgcaaaaaacaatttttctgtgatttgatttttttctgattttagataggtacggtaatttttttcgctagtgaattgatcaatcaagatagcatccggtgtttttggtgcgattttttgcaacagtagccgaatggcttgattgtgtagcgcaactttcattcgaacggtgttgtatttaggttggatctcattgtatttagttggttcaactgtcagtaattgataaggcacaagtttttttatttttggggccattgcccgaatttgtggatcagtcaacattttggagtctttgacacctaatgctttcaatgcgggtagctgatctttactggcatagacagcgcaaacgactaaaggaccaaaataactgccattgccaacttcatcactaccaacgacactccactgtgaaaagtcagcaggcaaggaggatgaaggagccttgttgttcgcatttgctgttttggacaagtcggcagaattgctccaacgagctgcttcagcttctgcaccactaccttgaaacatcactttaccagaagtataagcggtgatggtcgtttgttcttttttggcaacaaacacggtataaggaacttttttattcaacagcgcttgctgatagaagttcatcatttctgcgatagttttttgagatactttaatgacgatattactcattgtcttcctccgatatacatactggttatttgaatagaacatcttcttagattctaccataggtaaaaattttacgaagcctctttctaaaaaaacgattggcatggaaattacactagaaatcacgtataataggtaggagtttgcgatacgcgtgcagaaagtgataaaatagtacagaacagcaatgggaggaatctttcctatgacggagcaaaagaaacgttataaagcagtaatcgccaatcaaagctacacgattattgggcgtgaaagtaaacaacatatggatatggtaacgaaattagtcaatgaccaattgacagaaatcatggggctgtcttctcaagtcgataaagagcaagcagcaattctattagcaatcaatgcgatttctgatcagttgaaaaaacaagagcaagtattaagtttgcaaaataaggtagaagagttacgcagtcaagcgattaaggcgaccgaactagaaaatcggattaagcgaatcgaagcgattgagtctgaagcgcgccaagtattggatgagacaggtcgcggagatgtggagatccataatcatgtggaagctcaacaaatattaaatgaacaacgtaagcgcaaaatccaagaaaaagcagctcatggttaagtaggcgcggaaaggactctgaaatgataggatttttggttctggttcttttgttagcggcattttatggtggcgcgcggcgagggacttcattgcagctggtctccgttttaggataccttttttcttttttagttgcagtggcaaattaccaagctttggcaaaaaaaattgaattatatgttccttatatgtctgtgaccgcagactcaaagttggtcttttataacctagatcttgctctagacctagacaaagcgtactatgcagctgtcgcttttattatgatcctttttgctggctggttagtgacaaaattgatttgcatttttgcaaatggactgcgtttcaaacgtctgcgttttttcaaaggctatgattgggtcgtagcagggatcttgaatacgctattagtttacctgaatatctatttcttttttatgatcctctcgatgattcctttagcgactatccaaaatttgtttgataagagcagcacggcacactttatcgttgaaagttcgccaatcatttctgattacttttatcgtttgtggatcactaatgtgattggttagtataaggcagctggtcattagacccatgctgctttttttcttaagtaaaaaaatgaaaaagtaggtgagactatgaataaaaaaattcttgatgttttagctttcgatcaagtaaaacaattggttgggcagtatctagtgaccgcccaagggaaagaagaattagctcaattagcgccatcagcagatgctcagcaaatttccacttggctggctgaaacagaagatgcgttaaaagtacagcgattgcggggcggtattcctgtaccaaaaattgaaaatattcgtccgcaaatgaagcgaatcgaaatcggagcggaccttaatggtttagaattagcgcaagtaggtcgagtgttggtgacagccaatgaattgaagcgtttctttgaagatctatcagacagcgaaatcgagttcgagcgactgtatgaatgggaaaagcagttagtaacgctgcccacgcttagccgtcgcctgaaagaagcagtggatgaagacggtcggttgactgacgaagcatctccagagctacgtgtcattcgacaaaatattcgtcgttctgaacgaacgatcagagaaacgttagatagtctcgtacgtggcggaaatgccaagtatttgagcgataccattgtcacgatgcgaaatgagcgttatgtgattccggtgaagcaagaatatcgtggcgtgtttggcggggtcgtgcatgatcagagttcttctgggcagacattatttattgaaccaaaacaagtggtggatcagaataatcgactgcgccaacatcaaatcgctgagcgtacggagattgaacgaatcttagcggaactttctgcagagctagctccttatcaacgcgaaattctgcacaacgcctatgtgatcgggatgatggacttcatgaatgccaaagcacgttttgggaaagaattgcaggcaatcgtgccggctatcaatacagataatcatgtcgttttcaaacaagcacgtcatccgctgatcgatcaagaaaaagtcgtaccgaatgatattgctattggtgaagactatcaagcggtggtaattaccggtccgaatactggtgggaaaacaatcaccttgaagacgctgggattgcttcaaatcatggggcaatctggattgccgattttagtcgatgaagagagccaaatgggcatttttcaagaaatttttgctgatattggggatgagcaatccatcgaacaaagtttatctaccttctcttctcacatgacgacgatcgtcgatgttctcaaaaaagtggaccatacaagtttagttttattcgatgaactgggagctgggactgatccgcaagaaggcgcggcgttagcgattgctattcttgatgaacttggtgcacgctctgcctatgtgatggcgacgactcattatccggaattgaaagtgtacggttacaatcgtgccaataccatcaatgcttcaatggagtttgatgtcgataccctaagcccaacatatcgtttgctgatcggtgtgcctggtcgcagtaatgcttttgaaatctccaaacgtctgggcttggacacccagatcattgagcaagccaagcaaatcatggatggcgaaagtcaggacttgaatgagatgatcgccgacttagaaaactggcgcaagatgaccgaaacagagtatttggaaatgcggcattatgtagaagaagcggaacggctgcaaaaagaattgaaacaagcatataactttttctttgaagaacgcgaagcagaactagcaaaagcccgcaagaaagcaaatcaaatcgttgaaaaagcaaaagaggaatcggaaaaaatcatttcggatatccgcaacatgcaattgagcagcggacagagccatgtcaaagaacatgagttgatcgcagcccgcacaaaattgtctgatcttcatcaagaagaacatttgcaaaagaacaaggtcttgcaaaaagccaaagctgcgaaaacattgaaggtcggcgatgaagtgttagttacttcctatggtcagcgaggaactttgatcaaaaagatgggacaatcacaatggcaagtgcaattgggaatcttaaaaatgacgctgcctgaatcagatctacagccggcagcacctgtcaaagaacctgtgcagcgcgtcgttcataccgtccgttcagcggagtcttcacatgttcctaatcagctggatcttcgtggcaaacgctatgaagaggcattgaatgaagttgatcagtatctcgatgcggcgattcttgctggttacccacaagtgacgatcgttcacggaaaagggacgggggcattacggcaaggaattacggaatatttgaaaaatcatcgtagtgtcaaaagttttgagtttgcaccggcaaatcaaggtggcaatggggcgaccatcgtaaaatttaaataatcgttaaggcttcttaccttttgtaagcagaggattttaaaaaagcacgtgaacatgctatactttttttagcaatcaaatggaggcgaacaatatggcaaaagaaattacagataaaactttttcagaagaaaccgataaaggcttagtacttattgatttttgggcaacatggtgtggtccatgtcggatgcaagcaccaatcttggaacaattagcaaatgaatatgaagaagacgaattaaaaatcgtcaaaatggatgtggatgaaaatcctgaaacgccagcttcatttggtatcatgtcgatccctacgctattgttgaaaaaagatggtcaagtggtagataaagccgttggtgttcataccaaagatcaattgaaagaaatggtagcaagccacatgtaagaaaattttatagtaagcagcgatcttaagcgatcgctgctttttttttgagtagttttaagcgaggatttattcttgcaatggtataatgaaagtgtgaatatggggagcgtctactttctatggagtgcttttatttgaaaagggggatgaaaaatgaaaaagaatagaggatgggggtaccggctgctctgtatcatttccttggtcagtgcaccgcttgtatctgcaggtgcgacctacgcggaaacaattgatacaggaacttcttcagtcaatcaagtcaccgaatcaaccaccaataccagtaggacgacaaccgaaacgactgactcaacaactgcgacatcgtctacaatagacacgtcaacttccgaagcgagtaccaacagttcgactgatagctttggggaaacaactacaagtagttcagaaataactgtttcttccacagaagaaacggatacttcagaagcgaatccagtcatcactgttaaggaattagccaattcaaatcgctatgtcaaaatcaacactttcacagcgactacaacggagtcgcaagcaatggatagtcgtcaggttttatataccctcaatcaattgcaactaacagccacaggatcaattactgaacttgcgggtcacgtttataaaagtgtcaaacagtaccaagatacagcgacgaaaaagaagtatagtgaactacttgatgaacagaatcacgtgattggtattgttgaagcagagtctgtcacgacagcagatggggtgtttcagtcagaaaaaaaatatgctactgttcaaagtggcaattatcctttatgggagtcaattttttttgataaacagttagtcacgacaaaaacaatcaatcaacaaacgtttcaagtaaaagaaagtttcaaacacggaaacggctcgacctattatgctctgtacacggataagaaccaatttattggttggattaatgccaaaggagccgcggatgccaaatcacctggaggcatatggcaatctgaatcaaaatacgccacgatcatcagtggcaactacacattatggcaaaattttgattggtcagccaaaaaaggaacgacagctgctttgaatggaaagaccgtcaaagccacaggaaaatatagccatgttaatggtgcaacgtattattcgttgtatgacaataagaacaagtggttaggttatatcaacgctgccggtgtcaaaacgacatcaaatgcacagggagcttaccaggcttacggtaaatatgttactctaacaaagaaaaattatacaatttggggtaattttaactggtcgagcaaaaagaacactacctcttcattgtatggaaaaacttaccaggctaaaggaaaatatgaacattggaacggatcaacttactactcattgtctgattctactggcaaatggattggctatttgaatgctgaagccgctactgtggctaataatcaaggtggcatatggcagagtgaaaacaagacgatccggatgaaaagtaagaactatacattgtggcaagatttgaatttttctaagaagaaagcttcaagtggcaattatatgaacaaaaatatcaaagtcaccggaaaatatcagcattataacggtgcgacctattactcattgtatttaaacaatacatggatcggctatatcaatgctacaagtgtcacaaatgctcatgtaatccattcgcagagcaatattagccgttatgtgatcgtcaacaatgccagcgggaattttctgaatgctgctgatcctaacagcagcaaattaggaaaaaagagtaattataaagggtatatggcgaaagcaaccaaattagccaaaacgagtgatggcaattatctgtatctggtttcaccagcagggaaaatcgggtggctcaaagagaatcagacgtatagcgtgaatgataaattctggatgtacactactggtggcaagtacccctcgctaaatgtcaaaaatttaaacattcatgtgtccatcagtaagcagcgagtttacattaagtcaggcgacaaagtcatttataccatgctttgttccacggggacagtttttacgccgacaccgttaggtaattttagaattcagcaggagaaaggctccgccttttcaggagcggcttattaccgttctttcaaagatcatggtgtctatctattccataccgttccaacaagcattgcttggtcaaccaattcatttagttcggtggaaggcaaaaaaataggacagcgagcttctcatggctgtattcgattagcagtccctgatgctaaatggttctattacaacatgccttacaacactcccgtaaaaatcgttaactgattctagctgctgcatcctttgaataaggatgcagcagtttttttgtagcgaaaagagttgttgatttgcacttcactaattagagttgaaagtttttatcttctgaatagagatcaaggcctttttgatattttactttttgatattttgatagaagttagatttgtaaagtgggtcaattgactaaaaactgccctttgaaagctgtgtcgcccatttgggaaaaggatttctcttttgaatgactgacatgtccgttcgaagcttgatagggagcatcaatctcgaatccctagttgctaactaaggtaagtataaagcggtcaactaagtgtaaatagttctgaaatacgccgatagataatcagaaaactacccaaatccgggagaaaattgcttacaaaaagagattgacacttattatatcattcgataatatatcagtaagtgatatagtttcctaggatgggggaaaacacatggatgaaccattgaccgattcaacttatttgattttgttagctttattaaagccaaaacatggctatgtgatcatgaagcaaatcaatgaattaagccaaggtacctatgaaatcggtccggcaacaatgtatactatattgaaaaaattgaccaaaaatgaaatgatcagtttagaagagacgacagatcgtaaaaaaatctatcagatcacagccaaaggaaaaacggctttagaaaaggacattcagcgacgaaaacatttctttgagattggtgaacagattatgggtgagttggggggactggcagatgagcaaacgtaagacaaaacatttgtattcattaggtgttgcctattatccagaaaaagaaatgatgcggctgcaagagcaagcagcaaaaggttggcagtttgtgcatatgaatcagttcggttttttgaagtttattcaaagccaaccacaagagaagaagtttgctgtcgatttttttcaaggagacaaatctgatgttgatgaatacttggcaatgtatgaagccggcggatgggagtatattagttcctacaaaaaccgttactactattttcaggctcctttagagacaccagctatttttagtgatcagcaaagctatcaagaacgaatcgatagtgaggcacgctatcttatgaaacgttcttttggcataacaggtgttggcttggttattctgcttttgatttatctcctcgctcgctggctagtacttacctataatgagatactaggtttctcatatggtgttgcagttgggctgatttgtgcgcctcttgtcatcggtgtggtgtcatttctcatgcgtcgcttgtacaagaaccgcgcctctttttacaaagaaccagagaaactagctaagcggcaacacgtgttacgggatacgctgctctttatgggagtcggcgcattaattggaagaattatcggctttttagccggttatttatactaacttaaaagacaaggaaggtgaaattgtgttagaagcaaagaatttagtgaaaacatttggggactatcgggcagtggatcaattgtcctttcaaatcaacgatggcgagatcatggggctgatcggtcaaaatggtgctggtaaaaccacgacattccgattgattctagatttcttacgggctgaacaaggagaagtactatggaatggccatcaaatcacagaaaaggaatacaatttgattggttatttgccagaagaacggggactttaccctaaagtaaccatccaagatcaactgatttattttgcacgcttgcgtggaaaaaagaaagaagaaattgaacctaagatcgacgaatggatggaaaaattccaagtaaaagggaaaaagacagataaagttaaatcattatcgaagggaaatcagcaaaaagtccaattgatcgcaacattgattcatgaacctaaattagtcattttggatgaaccatttagcggattggaccctgtcaatgctgagttgctgaaagatggcattattgaactaaaagaaaaagggtcttgtgtcattttttctagtcataacatggataatgttgagaaaatctgcgatcatttgatcatgctaagagatggtcaaacggttctcaacggaaaagttcatgagatccgtgaatcgtttgggcggacgaaagtcttcttggaatcttcattgtcaaaagaaaccatcctagcagttgaaggtgtcgaaaaagttcttcataaagaagatgggagttatgacattacattatcgcatcctgaagtcggtcgcacattgtttgatttggccacagctgatggctatatcccgatgtttaaccaacaaccgccgacattagaagaaatctttaagagaaaggcgggaaaagacaatgagtaaattttgggtgatcgcgctcgatgtgtttaagaaaaacgtgaaatcgatctcgtttttgatcatgatattgattccatttattgcattgggcattatttatgtggtaggaatttttaccgatggaatgaacagtgccgataaaattgctgtttatgcgaatgaaccagctattgcacaaacaatcgcagctcagaaaaatgaagactatcaatttgaagtggtggattctgaagaagctggaaaaaaacaattagcggatgaaaaggtcgatgcattcttgatcgttacttcagaggccgacagtatcaaaggtgaattattgagtgaatcttctatgggacaaaccacagagttgacggttcagcaattattgtctgggttgcaagcctcgggacgtgccgcagcactcggattaaatcaggagcaagtggctagtttaagtgagccagcaaacttcagtaaacaaaaagtttctttcaccgaagatggcaaaatggagcttggggaagacaatagttcgatccaatacattgtgagttacgtcggaacaattattttattcatgtttattttgacttacgctcaaatcattgcccaagagattgcttccgaaaaagggacccggatcatggaagttattttgtccagtacgagagcacaggttcacttttatgccaaattaaccggtgtaattatggtcgcattagctcagttattggcttacgccggtatctttgctatcagttattattggatcaaagacatttcaatggtcaaagatgtattagccaatttctcaattgatggattattcggtccattcttgatttactcggtcatctttgtcctattaggaattttgatttactctgtcctgtctgctttgtgcggttcattagtcaataaagcagaggacactgccaaggcgatcattcctgtcacttacctttctttagccggttatatgttaggtttgattctaggcggtacagatcctaacaatatcattttgcgggtcacttcttatatcccgtttttatcttcatttatcatgccagtccgattggctaacgatacagtaggtatcggaggcgcggcagtctctgtagccatcttagcagtaagtacattggcattgatgctgatctcagcaagaatgtataagtcaaacgtactgatttataacgataacggcattttggcttcattgaaacaatctttcgttttgatgaagaatgaaaaatgaccagccaacaaattctccgattagttaggcttcaataaagaaaccgatgaaaagcttgtgctttctgattaccaaatggtatccagaaaaccctctgcttttcatcggtttttttctacgtagaattaggtaaagtagctttaatgagtcaagaccgccaattgatcaagctagtatccaatcagcctttaattactaactattaaagctaaacgagtcatttaaactactagtttcaaatataaccaagtcttttttcaatcaggcattgcctctgctagcgaaatctttgttggcataatgtcaaaactgatgaacaaagtagtcgaaaatttgctgttctgaagcaatttcttgtgcggttaattcaggatgccattggatccctaaaatcggcgccgcaaaggcagaagtttcaatggcttctacgataccgtcaggggcagttgcgatcacttggaaatcttttgcaacatctttaatggcttgatggtgaaatgaattcacttgataggtggttcctaataattttcctaaacgactgtcagcaacgatctcaacggcatgagtaggaaagcgaaagggtgtcggtgcttgcacatgcttgatggttggttgctcgaccaatgacaagtcttgatagaggttgccgccgaaagcaacattcaatagctgcatgccacgacagacaccaaaaattggtttttcttgtgcgacagcttctttgatcaacgccaattcaaatgcgtctcgttcaggatgtgtaccttggatcagtggatgcatctcttcgccataatagcgaggagtcacatcatgaccccctgccaaaagtaatttatcaatctgggcaacatattgggcggcattttcgggagctcccatgggtaaaataaggggaaggccagaggcttgttgaatctgtgtcacaaaatttctcggggtatatgtaatccaatgggcttccccatcaatcatcgttcgttcgttgccagcaattccaatcactggtttcataagcattctccttccagctgttttgacagcagtaatgaataaaaaactgtgacaaaaggaaaacaaaggaagctatccgaactgactttttccacgaaattgcgaggacctactagagagtagatgcaatttcgttatcgttcggatgctccatttgttgctgcacttaagtcacagtacttttttatttttcgcgaatcacttctattttgtagccatctgggtctttcacgaaatagtaagaaggagaagtaccaggcaagccttttaagtcagtaacatcaaaaccagctgctttatgctgctcgtgaagtttctctaaatcatcggtactgatcgcgatatgaccatagccgtcacctagatcatagccgggatgatcatagttataagttaattctaattcataatcatctcctggtaatgtcaggtaaaccaacgtaaatttgttttctggaaaatcacgacggcgcgattcttcaaaaccgaatgcttcttgataaaatgcaagtgatgcttcaagatctttcactcgcacacaagtatgtgccattttcatttgtcattcatcctttcaattgtggtaagcctataataacataacccgattttttgtggtaagaaaagtgcaccccgtcaagttgcagcttgtcgccagtggcttcctaaggtagaatggaaagaaagagatgatggagggaaacatggggaacaaggagaaagtgtttgggcaaaaagagccgggggctgactatatttcacgattcggtgcctatgtcgtgattccgaatgaacaccaacaagtgattttggtccaagcgccaaatggcgccttttttttaccaggaggggagattgaacccggtgaatcgaaggaagaaacgatcaaacgggaattggtcgaagaagtaggatttgcaggaaagatcgccagttatttaggggaggcggttgattatttttactcgcgacatcgagaaacgtattaccatcatccggcctatttttatttgatgactgattggcaaaaaataggtgagccaacagaacaacacaaccaactttcgtggcatacaccagaagaagccattcatttattgaaacgcggcagtcatgcctgggcagtgaaacaatgggtaaatcaaaaagacaacgatcatgcataaaggcagtgatcgttgtcttttttactcttttattttagttcatttaacacatagtcattgataactttagctacaccatcttcttcattggaagcagtgatgacgtcggccgcttgtttgacattttctgttgcattagccattgcaacgccaagacccgcatattcgaccatcgttagatcattttcgttatcaccaatcgccatgacttctgcttgtgagatacctagttcctcagctagcttctgaaccgcagcccctttatgagctttcttattcaagacttctaagaaaaatggcgcacttttgacgatattgaaacgctcagtcaatgaagttggcaattgtggaataatagcatcgatcaattcaggctcatcgatcatcatcattttgatgatattcagatccgcagtcatttcttccggtgtacgatatttcaaaggcatattgaccaaaaaggcttcatagacggtataaggactgatgtctcgattcgctgtgtacatcgtatcttgggtttccacatgcaaatgaacccctaatttacgggcagtcatttctacttctaagtattcttcatgcgtcaatccgaattcagaaacgatttcttttgttttagtcttctgtacgagagaaccattatatgtgattacgtagtccgtttctgaaaacaagtctagttcacttaataaatcttggacacctgttaaggggcggccagtacataagacgattcgaacaccctgtgcctccgcagcttttagtgcttggtacactccaggtgtgatttttcgatcattgttcagtaacgtgccatcgatatcgatagcaatcagtttgatgctcataacttcctcctagttgttcgtattgatcaaggcaccattgcgaatatgtttcgcaaactcttgatacgtatcccaaaataaatcatagtgattttgtagtgcggggtcaatcatttcttttgggaaataaaagcgctggtctccttgtgtttgaccagcaagtgcagctactagttgactagccttggataattccactagggagccgtctttttcttgcagttcgatttgtgtccgatgcatgccggaagttgggcgataaaagtcataaggtaaatcgaaactagaattgattgctgtgtaatagtcggggttaaaaccgactttttcgacaagagattgcagttcatgaatcaatggcaattgagtgtcttcttcaaaacgtgcagacttcagcggtttgcggttcaagaatcgtttggctaaatcactaagaatcggatcattttcttccgtccactgagtgaagtaagtattcaagacgccatcgtctagttttaggtattcttccaaagtaaagtgctgtttaagaaagggcagcaaaagctgggaatgcgattggaaaatttcttcatgttcttgatacaattcggcagcgcgatttagtaaatgtgccaagataacttccattccccgagaactggcatggaaatagacttggacatacatttgatagcggctgacaatataatcttctaccgcatgcatgccactcatagaaaatgcgatcccgccagcatagggacgaatgactcgcagaatacgtgtcaaatcaaatgtgccgtattccgttcccgtgaagtatgcatcccgcagtaaataatccatgcgatccgcatcgatctgactggaaatcatttgcaccacttgtgggtttgggtatgtcttagtaataacactggccactttttcaggaaaaccttcttccacacgattgaggatttgatagacttctgtttctggagaagtaatgatcgctacagtgatggcttcgtgatcggtatgaaaaatatgttcaaaagtgtgagaataagggccatggccaacatcatgcaacaaagcagcacaaagcgtgaccaatcgttcccggtcatcccagccatcagacccaactttttcaactgggaaatttcgttgaaacaaatcacagatgcggcggctaatttcgtaaacccctaacgaatgtgagaagcgactatgttcagcaccatgaaaagtaaacgaagaagttcctagttgtttgattcttcgcaggcgctgtacttctttcgaattgatcaagtccaagatcacttgatgctgcacatgcacatagttgtgtacaggatcacggaatactttttcaatagcaagtgtttgatacttatatgggatgctcattgtgaactctcctttatcggttgatttcgttgatacatattggtcatacgagcctctagtaatgccgcttgatcatttttttcaacccattcggatgcagtcacagggctgagagaggacttagttagccgcatcaaggcctcttgcagtcgtgaggcagcttctgatacagagaaagaacgctgaagcacatcttggagtgttgtcatactggtaggttcaacggcgggatagccattagtaccaaactgctctttcaagcttctttgataaaacgttcttactacttctcctcgatagtgttggtcgccgttgacactaaggtacatcatgactgcaattcctgctttgatcctgcgctgggcagtccctgcgattttctttccgtccatactcaagtcaaaggtaccgggacaataagagtttgggatttcataggccgcaatttctttttcgggaaatgcttctcgcatcaagtcgaccattcgctgataagccgcatctgtagtagcagctaacgtttttgggaaaatccacgatacattcagaacaccggcatcgttgatgaccccaagcccgcctgagttgcggatgattggttgaaagccagcagtcgtcaaagcggatattccttcggtgaaataaggcactcgggtatctttcattcctaaaatcatagtatcaggcaactgccaaaagtgtaaaaattcctgatgatgaacgcctgcatattcactcaatacatcggtcaatgcaaacggtaaaaaacgattctcggtagtttggggatcaaatggcaacatttgatcaatcatttcaatggtcacggtaggcttagattctccttcaataataagatctcctactattatatatgaagatcatgaaaaaacttaatcaaaaagctaagaaaacgttctatagtggatgttttagctgaaatgattgacaaaagaggggaaaaaaggaaaaatgaaactgaaatctgctaaggaggcacactatcatgagggaattgtcacaaggaattccgatttcgatccatttaacgacaaaggtcgaacaagcgggagaaacacaagattttttgtttgatttacaaggacaggcggtcaaaatcggcgatacgctgtatctgagatacaaagagattcagccagaaggagccgaagtaccagtgacgatgaaaattatgccagatggcgtgatccaactgattcgctcgggagaaatgcgaacacgcttgaaattcgcttacaaagaacgtttagaaacaagttatcaaacgccttacggcacgatgcatttccatacatatacaagtcacttacatgtgagtctgaaagatcgtccttattcaggtaaagtcgatgtccattatgatttatttatgatggaagacaaagtgggagaatacaaactttctttggagtttactgcttaaataaatgcaaattttgaaagaataaattgcaatttgtctcacatttttgtatgattaggagtagactgtgaaaggacgtgtcccgtttggaaattaatgtatttgaaggtgtaaataaaaacgaattgtcaatgatcgaagttgcccatgcgattttagagcaacgcggtgacgtgatggatttttctgatttggtcaaccaaatccaaaactatctagaaacttcggacagcgagattcgtgattctttggcgcagttttatacagacttgaatatcgatggcagttttatttctttgggagacaatcgctggggattgcgttcatggtatgcgatcgactcaatcgatgaagaagtcaaccacggaatcgatgatgaagatgaagatacaccgcgtcgtcgcaaacgtaagaaagtgaatgcctttattagtgacgatgaagacgcgatcgattataacgatgatgacccagaggatactgatttgtctgatgacgatgaagaggatctttttgacgatgatgacgatgaggatgaagaaatctccgcatataactcagatctgcaagaaattggtgcagacaataacgatgatgacgaagaggaactaccagggaacattgaagaagatctaacgatcatcgatgatgatgaagaagacgaatttgatgacgaggaagaagaggaataggcctcttcttttttgtgtttagcaaaggcaacagcgtatggaagatggcaagagctcaatcaaaataaaaaaccacggaagtgctgtcagcacttccgtggttttttgaattatcccttgagataaagtatactataaatgaaatgaaaaacgcgccttgagggaatcgaacccccgtctcaagaaccggaatcttacgtgatatccactacactaaaggcgcgaagcacaaataacagtttaaccaattttctcagaaaaaacaagaggtaaaatgatgaaatttcaacaacaattttcgcaacaacaaaaacagacacaaaagttggcgatgacgcagaaattacagcagtcgatccaagtgctgcaattttcatcagatgaactgcttgctttcgtagataatcaggcattagagaatcccctgatcgatttaacggaccatgaatatccgacgagttatactcaaggcagtgggacatctgagcaattcaatgaatatttgaatcagatcccaaatagaggaagttcgctctttgagtatttgatcgatcaaatccatttaaattaccgagacacctttctacgcaccgtcgtgttatttctagtggaatatattgatttgaatggatttttgaccattgatttggtgaaggctggtcaaatgatcggagcttcagagattcagatgctcgatgccttgacactgattcagcagttggatccagcgggtgtcggcgcacgagatctacgagaatgcctcatgcttcagactgaacgggacgatgctgcgccagaactcgcctatatcgttcttgaagaatggttcacggaattagcagagcgcaagtgggacaaaatagcgaaaaatctagcagtttcgctttcagaaattcagaaggtgtttgactatatccaaacgttgactccaacaccaggggcggcctttgggtctacagatggtttgtatatcatcccagatttgcgagttacgattactgaaggccagccagcggttacctctaatcgacgagcaatgccggaagtccgtttccaacaacactattttgatcaattaaaacaaagtggcgatgctgaggtaaagaaatatttagacaacaaagcccaagaatttgaatggctaaaaaagactctccagcagcgaggagataccatctatcgagtgggagaagcgatcgttcatcatcagcaagacttttttttacaagctgaccgaccattgaagccattaatcctcaaagaaatcgctgacgaattaggtattcacgaatcgacagtcagtcgtgccgtcaatgggaaatatttggagacagaatttggtgtttttgaactgaagtccttctttggtcaaaaagtgtccacccaaagtggagaggatgtcaccacggaggcaatcaagcgacgtttggcagctttgatcaacgaagagaataagcagaagccgctttctgatcaaaaattggctgatttgttaaaagcggaagaagtggaaatttctcgacggactgttgccaagtatcgtgaggctcttaatattcctggatcttctaaacgaaagcggtttgattgatttttcgatacagttcttgttctgatccagctattgaagaaagattcaacaagaatgacggcaaaaagtccaatgaccccacctcttatacataagaagacaggtaagcaatttgggtttcatataaccgtagcaaaggcagggctacttgtgataaatagctctgcccgcttttcataggcggtcgctgatccttttgctcgagtttttctttgttgatttcttttactagtttgaaagctatttttggctgtgataagaatccgctttacggttaaaaaagtttggagaatcattttttataattgaaatagttgcatgaggcgtccagaagtgctactattattggtgtaagagatgaattaaattttttttggaatagatgggtcattttaagtcattgtaggacaaaaaaagtccaacgggaggatgcaaaatgctcgatgaattgaaattgattgaggcaatcaccccggatatcctcgcggtgcttcaagaacgttaccgtattttacggactatctattggatgcaaccagtagggcggcggacattgtctgaaagcttagcaatgacggaacgtgtgttgaggtctgaaacggatatcctcaaaaaacttaaattgattgattcgtctaaaagcggtatgcaattaacggcctatggcgaagaaatctatacaaaaatcggcagtttgatggatcaattgtttggcatgcatcaaacagagaagcggttatccgagtacttcgggattgatcgttgcttgattgccagcggtgatggggaccgtcaaccgaaagtgattgctgaattcggtcagctgcttaatgagtcgttagacttattgctgccagatggtgagaatacgatcgctgtgatgggcggtacgacaatggcaaaagttgccgaagaactaggcaatcttgaaactggcaaacgccataacttgtttgtcccagccagagggggcatcggagaagcagtcaatgttcaggcaaattcagtcggatcagtgatggcgatgcgtaccaatggtaattatcgttccctatttgtaccggaacaattaagcactaacacctatgaatttttgttgaaagaaccagcgatccttgatgtcttaaacttgataagtcaagcaaattgtgttattcatagtattggacgagcactgcatatggcagctcgaagaaagatgtcagaaaaagagatcctgatgctgaaacaaaagaatgcagtagcggaatccttcggttatttctttaatgaagcaggcgaggtcgtttataaaattcctcgtatcggactgcagttgaaggacttgcagaacgtgccgatcattttcgcaatcgcaggcggtaaatcaaaagccaaagcgatcaatgcatacatgaaaaatgcaccaaaacaaacatggctcatcacagatgaagcctgtgccaatgagattttaaaaggggcaaccctttaaaataaatatttttatgattttcataaggaggaaatcttaaatgacagttaaagtaggtattaatggatttggacgtatcggacgcttagcatttcgtcgtatccaagaagtagaaggaatcgaagttgtggctatcaacgacttaacagacgctaaaatgttagcacacttgttaaaatatgatacaacacaaggacgtttcaacggtacagttgaagttcatgaaggatcattcaacgtgaacggaaacgaaatcaaagttctagcaaaccgcaaccctgaagaattgccttggggcgaattaggtgttgaaatcgtgctagaatgtactggattcttcacttctaaatcagctgctgaaaaacatttaacagctggtgcaaaacgtgtagttatctcagctcctggcggaaacgatgtaccaacaatcgtttacaacacaaaccacgaaactttaacaggtgatgaaacagtaatttctggtgcttcatgtacaactaactgtttagctcctatggctaaaacattgaatgacaaatttggtgtgatcgaaggcttgatgactacgatccatgcttacacaggtgaccaaatgactctagacggaccacaccctaaaggtgacttccgccgtgcgcgtgctgctgcagcaaacatcgttcctaactcaactggtgctgctaaagctattggcttggtaattcctgaattgaacggtaaattagacggagctgctcaacgtgttcctgttgcaactggttcattaactgaattagttacagttcttgacaaagaagtaactgttgacgaagtaaacgcagcaatgaaagaagcttcaaacgaatcttacggttacaacacagacgaaatcgtttcttctgatatcgttggtatgacttacggttcactatttgatgcaactcaaacaaaagttatgactgttggcgacaaacaattagttaaaactgttgcttggtatgataacgaaatgtcatacactgcacaattagtacgtactttagaatacttcgctaaattataagatttgcgtcgtacattcatttaaaccatcgcaagagaaagcggggaagcagcgcgcttctccgctttttttaacaattacattaggaggaatctgttcatggctaaaatgacagttcaagatatcgatttaaaagataaaaaagttcttgtgcgtgtggatttcaatgttccattgaaagacggtgtgatcggtgacgacactcgtatcaaagcagcacttccaacaattaattacgtgatcgaaaatggcggaaaagcaattcttttctctcacttaggtcgtgtcaaagaagaagcagataaagaaggcaaatctttagcaccagtagcaaaacgtctaggcgaattgttaggcaaagaagtgactttcgttcctgaaacacgtggggaaaaattggaagcagcaatcaacaacatgaaagacggcgatgttgttgttttcgaaaacactcgttttgaagatgttgacggcaaaaaagaaagcaaaaacgatccagagcttggtaaatattgggcttcattaggggatgtttttgtcaatgatgcatttggtacagctcaccgtgcccatgcttcaaacgtcggaatcgcttctacaggaatcccaacagttgctggattcttaatggaaaaagaaatcaaatttattggtgaagcagtcgaagaaccaaaacgtccaatggtagcgattcttggtggtgcgaaagtatctgacaaaatcggtgtcattgaaaacttgattcctaaagcagacaagatcttgatcggtggcggaatgacttatacattctacaaagcaaaaggaatggaaattggtaactctcttgttgaagcggataaagttgagttggcaaaagaattgatcgaaaaagctggcgataaacttgttttaccagttgactcaatcacagctgctgaattttcaaatgatgttccaacagaagaacatactggtgatgttcctgaaggtcaaatgggcttagatatcggacctgaaacaattgcattgttcgctgaaacattaaaaggtgcaaaaacagttgtttggaacggaccaatgggtgtgttcgaaatgtcaaactttgctaatggtaccatcggtgtttgtgaagcaatcgcaaaccttgaagatgcaacaacaatcatcggtggtggagattcagctgcagctgcagaacaattaggttttgctgataaattcactcacatctcaacaggtggcggtgctagtttagaacttctagaaggtaaaactcttcctggattagcagcaatcaacgacaaataatcaagcaatgacgcggctgcgttgcaataagcagccgtgacccttaaataacaaaggagtgccagaaaaatgcgcaaaccaattattgccggaaactggaaaatgaataaaactgcgaaagaagcaaaagaatttgctgaagcagtcaaaacaaaaattcctagcaacgataaagtagattctgttatcggagcaccagcgttgttcttggaaacattagtaacagctgcagaaggtacagaattaaaaattgctgctcaaaacagctactgggaaaatgaaggtgcctttacaggagaaacttcaccagctgctttagctgacttaggtgttgactatgtaatcatcggtcactcagaacgccgtgaatatttccatgaaactgacgaagacatcaacaaaaaagcgaaagcaattttcgcaaatggtatgatcccaatcctatgttgtggtgaatctttagaaacttatgaagctggaaaaacagctgaatggatcgaaggacaaatcactgccggtttagaaggattgacagatggccaagtcagcaatctagtcattgcttacgaaccaatttgggcgatcggtacaggtaaatcagcagatgcacaaattgctgatgaaatctgtggtgttgtacgtcaaacagttgaaaaattatacggtaaagaagtttctgatgctgtacgtatccaatacggtggttctgtaaaacctgaaaatattgcagaatacatggcaaaagaaaatgtagatggagcattagttggcggcgcaagcttgcaagctgattcattcctagcattgttggatgcagtaaaataatttcattctcatgaaaatattgtttgcagaaaacagcttttttcactacaattaagatgttcgcaagggagattcccttaagataaaacaaactcaaaggagagacaaaacatgtcaattattactgatgtttacgcacgcgaagtcctagactcacgtggtaacccaactatcgaagtagaagtctacacagaatcaggtgctttcggccgtggaatggttccttcaggagcttcaacaggtgaacacgaagcagttgaattacgtgatggcgacaaagctcgttatggtggtaaaggtgtaacgaaagcagttgacaatgtaaataacgtcattgctgaagcaatcatcggctacgatgtacgtgaccaaatggctatcgataaagcaatgatcgctttagatggaactcctaacaaaggcaaattaggtgctaacgcaattcttggtgtttctattgccgttgctcgtgcagctgctgattatttagaagtacctttataccactacttaggcggattcaatacaaaagtattgccaacacctatgatgaacatcatcaacggcggatctcactcagatgctccgatcgctttccaagaattcatgatcttgcctgtaggcgcacctacattcaaagaaggtctacgttggggtgctgaagtattccatgcattgaaatcaatcttatctaaacgtggtttagaaacatcagtaggtgacgaaggtggtttcgctcctcgttttgaaggaactgaagatggtgttgaaacaatcttagaagctatcaaagctgctggtttagaaccaggtaaagacgtttacctaggatttgactgtgcttcttctgaattctacgaaaatggcgtgtacgactacacgaaatttgaaggcgaaaacggtgtgaaacgtacagctgcagaacaagttgactacttggaagagttagttaacaaatacccaatcatcacaatcgaagatggtatggatgaaaacgactgggatggttggaaactattgactgaacgtctaggcgacaaagttcaattagttggtgacgacttgtttgttacaaacactgaaatccttgaaaaaggaatcaaaaacggtatcggtaactcaatcctaatcaaagtaaaccaaatcggtacattgactgaaacattcaatgcgatcgaaatggctaaagaagctggttatactgccgttgtttctcaccgttcaggtgaaacagaagattcaacaatctctgatatcgcagttgcaacaaatgctggccaaatcaaaactggttctctttcacgtactgaccgtattgctaaatacaaccaattactacgtatcgaagaccaacttggtgaagttgctgaatacaaaggcttgcaagctttttacaacttgaaaaacaaataatctttcgatgattacattgctctgaaagagcagcggttgatttaacaaccgctgtgatttcagagcttttttgctgtctggattaagtgatttgaatcaagacttatttttctcatggaacagagagcagtcttttcttctttattttctttttctaaaaaaagaaattatagttctggtttagcgaaactctataataaaagaaaaaataaatttaggagaaatacatggtgtatgattatctaatcgttggtacaggactatttggctcggtttttgcttatgaagcagctaaacggggacactcggtgaaaatgttggaaaaacgagcacatattggtggcaactgttatacagaaaaacaagtcggaattgacatacataaatatggtgcgcatatctttcacacatcgagcaaaaaaatttgggactacgtcaatcagtttgctgatttttatccctatattcatgaacctattgcaaactataaaggtgagctatataatctccccttcaatatgaacacgttttaccaattatggggaaccaaaagaccagatgaagctcgcatcaaactaatggctcaaattgaaaagacaggaataaaaagaccccgaaatttagaagaacaagctctttctttggtggggacagatatttatcataagctgatcaaaggctatacggaaaaacagtggggacgaggatgtgctcagctaccttcttttattattaaaagactgccggtccggtatacatttaacaacaattattttacggatacttttcaaggcattccaaaattgggctatacagaaatgattcaaaaaatgctttcaaatccactgattgaagtttctttagaaactgatttttttgcagaccgtacgcgtcatgaagcatcaaccaagaagattgtttatactggaatgattgaccaatattttgactattgttacggggagttggcctatcgttctttacattttgaaactggaacatatgatacagataattatcaaggaacagcagttatgaactttacagacagtcaaacgccctatacgcgaatcattgagcataaacatttttgtccagttgtgacaaaaaaaacagttgtcacgaaagaatttccaaaaacttggcggaagggagacattccttactacccaattaacgatcaaatcaatcatgctctgtatcgcaagtatgaaaaattagcgcatcagcaaaaaaaatgtttatttggtgggcgtctagcaaactatcgttattatgatatggatgatacgattgcagccgctttaaaactagtcaaacatgaatttcaagcagagtgacttcttttatggaagaggttgctctttttttgtcccgattctgggacaaaacgtaacttttttactagttatgaaataatgaattgtcctatcttttaaaaataggactaggggaagcttataaaaatagttttatgaaaggggagaaaaataaacgtaatgagtaaaaagaataattatcgaaagttgctacgctccaataagagtgaacgctacaagatgtataaaagcggaaaacattgggtctatgcaacgatcacttcttttactggcattgctggattgagtatcacaccaatcgtggcgcatgcttcagaaatcacaccgcctttagatgcaagcaaagaagcaaatgccgagaacgtcttggcaaataaaacgaatgccaaaattcctgcttcatcgacgcaagaaagtgaggctacttcacaatctgaaagcatgcgtccatcggaaagtttttctgaatccgaaagcaacacccagtcacaaagtgcgacagagtcaacgagtgtaacagaatcacagagtatgagtgattcagaaactgaaaacaatgctaccagtatcgaggcatctcaaagtgtttctgaatcaatgagtctttcggaagagaagagcggatctgaatcagaaagtttgagtatctctgaaagcgcctcgatttctgaaagtggctcattgtcgtcaagtgcctcagaatcgacaagtctatcgttgtcacaatcgacaagtggctctcattcaacttcagtaagtcaaaagaaccaaccaaaacaaactgtttccgaaaaaaataaagtggagtcacaaaaagcacaagatctcttcgatcaattagtacccaagaaagtacaagcgtcggttgacaccacgacgaatgcattagaaattgttgtcaaagatggcaaatcaccaagcacatctttgattcgggcagcacaacaatatgctagtgccaataatttgattgctagttttgccatcaccacccaatcagggcagattgttaaaatcaatgtttctgcggatccagatatgggccgagaagaatttgagcaggcaatcaacgatggtaacaaaaccaattcaccttctggggtgacggttgatgttccggaccaagtgaaaaataaggaattatacaagcaaacagctattgctaatggcacttatgcagcagtgaatgactgggctacgctgaaagcagcatatggaaatgcttcgattacctatattgaggtaaccgctaatattacggcagctaccaatgtggctacccgtgatttaggatggcgggcaacgagtgtgattattgacggtaatgggtttacagtcaatatggcaggagcagcatttaatgtagggacaagttctacagttcgcggttctatctttacgatcacagatgtgaatttgattcattggcaatcaggtaccaactcaggagacagtggcacaggtaatgcagatggagtgatcgattcacgatcagcaaccggaggttatgggtactggtacttcaatatcaataatgtgactctcgaaggccgagatggtgttagcgggacagatacctcataccaaccacgacgattgctggatgcagaggacagtcacgttactttatcaggtaaagtcatcgcaaatgtcaaacaagaattgatgcaaattggtgaagtagcaatcgctaacggagcccatgtagagttgaatcggacagctggtactaccggctactccatgttttactatatggcaatccgtggcaataatgcgagtgatacaggattcaatcacacctttaaagtgggcgatggcgcgacaattattggaaacgagctaagtacctataacagcaacaactatccccttgtctattatggatttaactcaattactgtcggagatgacgtaacttggaaacaagacggtttccaaatgctactcgatttttctcgttactcgggaagtcaatcaaatgaccgaaccgcaacttttggtcaaaatctgcaaatgacggcaactcgtacagtaggttccaactcgctaaacgtcacgaatagagcggttgttacatttaatgcaggaacggtacttgatctgcaacaatggaatgccaacactgttgtgaacgtggcttccggtgcaacagttcgctttatttcaccgcgggcattgcacttagcccgtctaacttcttcaggagctgtttcggcaggtcgattgattaccggttcgggaacatttgtcatgaataattctcagatcagtacatggcaaggcagcagtagccaaaccgctgctccagaaggcaaccgtaacttaaaattcgtggaaatgactatttcaggttcgacaacaactattaaagatacggctggaaatgttactacatctaacattgtagacacttctacccgtgaattagcgactgttgcgattgcgccaggaaccgtaaccgtaaattatgttgatcagtacggcaatattattaaaactgttgatatgccaattgatccagacgttaattacattggtgagtatcttgatttgcaaacattggagtatgccaatgagttaatgcctgaaaattatatgtgggcaatcggtacccaagttgctagttcagctaaaaatgatggtcaaagcggcggagatagtacgactaatgccgataatggggacagctatgggcaagcgacggttgcgattgttccaatggagaacacaaattatacttataatatttatgtatatggtgttgccaatcattcggttcagtaccaatatgtcgacgttaagactggtcaagtaatctcttctgagtatatgaatgctggtaccgaagcttccggaacagatagaattcctgcaaactacgggaatgttatcgattggacaaatagttactatacttcgactaatttgccaccaggttactattatgcaacaggtgccgtattgaatggcaatgtacagcctggatctactacagttggaactgaagcgagtctgacaaccatttacgttgcagcagacacacaaactgtcaatgtaacttttgttaattcagatggccgtccattacaaaaccaagttggcacagttgctatcaatgggacgactggtcaagaactaagctattctgacttaatcgcagattacctaactcaagctggttattatgcagatcaaactggaacatttgtttttgatagtactagtaataatggcagtacaacagacagtgatcaacaatttattacgatcactctttatccatcctatcaagaagtcggtgtcgttggtaataatcaacctgaatcagatcctgctacaggggaagcatttgagcaaatcccaggaactgtcactgttggaaaatatggtacttccggtgtttcaaatgaaagtttcactcttggggtgacagatgcagatttagagagaaatgggtatatctatacggttacaggaccagatggagtagtctacaatacattagcggaagctatggctgccaatcaaacttttgatactaccagcaatggagcatctcaaacggattcttcgccacagatgtttacggtcaattatgaacaagacccggtatcattgtctacgtccgagtctatttcgggaagcgaatcattatcagaatccattgttacttctacttctgagtcagaaagtgtttctctttctcaatcaatttcagaaagtgactcattatcagaatcgatctctgttagtgattcagaatcaatttctacatcaattagtgcgtctgtttcagtatcagattcagagagcaactcagtgtcattgtctatttcagaaagtgaatctgacatgaatgactcgacttctgaatcattgtcaacatcaatctctacttcaacttctttaagtgattcagaatcggtttcgatttcattgagtgactcagagtcaacgtctctttctatcagtgaatctgtttcggtatcagactcagaaagtggttcgttatctacatctatttcagaaagcgaatcaatgtctctatcaatttctattagtgattcagaatcgttgtcagaatccctatctgaaagtatttcaacatctatttcattatcggatagtgattcaatgtcagaaagcctttcggcatcagaatcgttatctatatcagctagtgtatcagagtctgattcggaaagtgatagttccagcttaagtgcgtctgtttctggatcattgagcaacagtacaagtgattctgaaagtttatctttatcagagtcagtatcagtttcactctcggaatcactaagtgaatccacgtcactatctctgtcagaaagtgactcagtatcagaaagtatttcagcatcagaatcattatctgtcgctatcagtgaatcggattcttcttccctcagtgaaagcattagtttgagtgaatctatttctgattcgttgagtgcaagcatgagtttatccgaaagcttatcggagtcagaatcgatctcaaattcaattagtacgtcgatgtcattgagcattagcgatagtaatagtgagtctagtagtgaatcagccagctatagcggcagtacgagtgtaagtaatagcgattcaacaagtgaaagtatttctgcaagtaattcactatcagtaagtatcagtgagtcaaccagtttgagcacatcaatcagtgattcatcctcattgagtacaagcatttctaactcactaagtgcgagcgaatctgcaagttacagcagtagtacgagcgtaagtaacagtgattcgacaagtgtgagtacgtcagttagcgaatcaacatctacaagtatcagtgactcaatcagtgccagcatatcaactagtgattctttatcggtaagtattagtgattcaacgagcttgagtacctcacttagtgattcatcctcagtgagtgtcagcgtttcgacatcactaagtgcaagtgaatcaacaagttacagcggcagtacgagtgtaagtaatagcgattcaacaagtgaaagtatttctgcaagcaattcactatcagtaagtatcagtgagtcaaccagcttgagcacctcacttagtgattcattgtcattgagtacaagtatttccgcctcactaagtgcgagtgattctgcaagttacagtggcagcactagcgtaagtatcagcgagtcagcaagcttgagcacatcaatcagtgattcatcatcattgagcacaagtatttctgcatcattaagcgcgagcgattctgcaagttacagcggtagtacgagcgtaagcaacagtgattcgacaagtgcaagtacgtcagctagtgagtcaacatctgcaagtattagtgactcaacaagcataagtacgtcgatcagtgactctatgtcattgagtacaagtatttccacatcactaagtgcgagcgattctgcaagttacagcggtagtacgagcgtaagtaacagtgactcgacaagtacaagtacatcaatcagcgattcgttgtctctgagcacaagcatttctgcatcactaagtgcgagcgattccgcaagcttcagtggtagcacaagtgtaagtaacagtgagtcaacaagtacaagcacttcgatcagtgattcattatcagtaagcacaagtatcagtaatagtgaatccgcaagtgcaagtacgtcaatcagtgattcatcctcattgagtacaagtatttcggcatcactaagtgcgagtgattctgcaagttacagcggtagtacgagcgtaagtaacagtgagtcaacaagtacaagcacttcgatcagtgattcattatcagtaagcacaagtatcagtaatagtgaatccgcaagtgcaagtacgtcgatcagtgattcatcctcattgagtacaagtatttcggcatcattaagcgcgagtgattctgtaagttacagcggtagtacgagcgtaagtaacagtgagtcgacaagcgaaagtacgtcagtcagtgattcattgtcagtaagcacaagtatttccgcatcattaagtgcgagtgattctacaagctacagtggtagtacgagcgtaagtaatagcgagtccacaagcgaaagcacgtcactaagtgattcttcgtcgctaagtacaagcgtaagcaacagtgaatcaacaagtacaagtacgtcgatcagtgattcattatctgtaagtacaagtattagtaacagtgaatcagcaagtgtgagcacatcaatcagtgactccatgtcattgagcacaagtatttccgcatcgttaagtgcgagtgattctgcaagttacagtggcagcacaagcgtaagtaacagtgactcgacaagtacaagtacgtcgatcagtgattcattatctgtaagtacaagtattagtaacagcgaatcagcaagtgtgagcacatcaatcagtgactccatgtcattgagcacaagtatttccgcatcgttaagtgcgagtgattctgcaagttacagcggcagcacaagtgtaagtaacagtgattcgacaagtgtgagtacgtcgatcagcgattcgctgtctctaagcatgagtatttccgcatcattaagtgcgagtgattctgcaagctacagcggcagcacaagtgtaagcagtagcgattcaacaagcgaaagtacgtcagtcagcgattcatcctcattgagtacaagtatttccgtatcacaaagtacgagtgattctgcaagctatagcggcagcacaagtgtaagtaacagtgactcgataagtacaagcacatcgctaagtgattcattatctgtaagcacaagtatcagtaacagcgaatcagcaagtgtgagcacatcaatcagtgattcatcctcattgagtactagtggtttggtttcacaaagtgcgagcgactctgcaagctacagcggtagtactagtgcaagtattagtgaatcaacaagtacaagtacgtcagttagcgattcgcgggctagtgaaagtcaaagttatagcagtagtacttcagccagcttgagcctgagcgcaagtgtcagcacttcagtcagtgattctgcttcaattagttcaagtatcagcaacagtgaatcgaatagtatgagtacgtcaatcagtgattcacgttctagtatgagtgaaagctatagcagcagtacttcggcaagtattagtcaaagtactagtgacagttctagctacagcagtagtacctcagcaagcattagtgcaagcactagtgatagtacaagtattagtaatagtgcttctgtaagtatgagcgaaagtttgagtatcagcacatcaataagtgactcgttgtcaatcagtgcaagcttgagcaatagcgatagtctttcagaaagtagatcatttgcaagtgaaagtcaaagctacagcagtagtacttctgcaagtctgagtctcagcacaagtactagtatttcattgagtgattcatcgtcaactagcatgagcaacagtaccagcttgagtactaacttgagtcaattgacaagcgactcgctttccgaagggattagcttaagtaatagtctaagtaatagtttcagtaatagtacttcagctagtacgagtttgagctcaagtacaagtctaagtgaacaactatctcaatcagtaagtgccagcgagtcacggagtgatagcgtcagctatagcagcagcacgtcaattagtacgagtgaaagcagcagtactagcttgagcgaattactatctcgttcagccagtgccagtgagtcgcggagcaatagcttaagtcaaagcacaagtacttcctttagcggaagcagcagtactagcttaagtttaagtgaaatgaactctcaatcaacaagtgctagtgagtcacggagtgatagtgtaagcaacagcatgagcacttcaatcagtgatagcttgagtgcaagtactagcttaagtgatttactatctagatcagagagtgcgagtgaatcgcgaagtgacagcctgagctatagcggcagcacatcgatcagtaacagcttaagtttaagcacgagccaaagtgatttagtatctagatctgaaagtgcaagcgaatcacgtagtttcagcacgagtgatagtgctagcacatcgatcagcaatagcgctagtgcaagtgacagcttaagtgatctatattcaagatcgaatagttctagcctttcaacaagtgacagtacaagtaccaatgattctgtctcagcaagtgctagtgaaagcactagcacctcacaatcaattagtacgagtctaagcgaatcggcatcaatcagtacgtcgcttagcgaaaaacaagaagtgattgagtctcaaagtgtgagtgcttcaacaagtgattcacaaagttcgagtataagtgaatcagttagcgtcagcatcagtactagcgaaagcgagcggaatagtacggtggtttcacctagcgaatcaacttcgattagtgaaagtattagtacgagtgaaagtttccgagattctgaatcggttagtgcaagtgacagtacaagtttgagtcaatcaatgagcactagcgaccaagtctctgcttctgagagtataagcgacagctccagcactcgtgattctgagtctgaaagcgcaagtatttctacggaagaaagccgcagtttcagtacaagtgagtcaatttctgcaagtgaaagcacatcgattagtcaaagcgaaagtgcaagtatgagtgaatcagccagtgaaagtacaagtacgagtgatagtgaacgtgattcaatgtcgaatagtgcaagtgtaagtgattcgaactcaacaagtgaaagtctaagtgtgagtgaatcagctagcgaaagcacaagcatcagtgatagtgaacgtgactcaatgtcaagcagtgctgagacaagtgaatctggctctacaagcgatagtacaagtgctagcaactctgctagtctgagtgaaagctttagtgcttctgatcgggactcagtctctatgagcgcaagcgaatcaatcagcgaaagtacaagcgttagtgaatctgcttcgttaagtacaagtacaagtgatgtcaactctgaaatcgtcagtgactatcatagtaatagtttgtctgaaagtctttcagaactacaatcgcaatcaactagtcaagatcattcactttcagaaagtgcatcaatcagcggatctacttcaactcctacaaattccgagcagaataatgcaacgaacggaaatacaggaacgtcacaaggcaacataggagtggggggacatgcgactggagccactcttcctaagactggtgaatctgatgcaagcggtagtcaaatgtctcttgctggaattgccgcgctgttagctgcgattgctttaatgaaaaagaaaaaagatgcagcaaagcgtgaaacggattaatcagttcctttcagtttatgaagggctgggataaatttcctagctcttctaaaatgatagaagtgttactactcaataaaaaagcgtcacagttagattttcctaactgtgacgcttttttattcgctatagccgattatggaaattcaacatcgaatgaaccgtcttctgtttttaccaactcggataataataaatttctgattgcttctagataaattgcttcacgcatttgagtgaaagaacggtgtgcctctacttgaaactcatagatgggacggtgttgtccccagtttcttccattgatgactgttttcaattgttgcaagttgtctgattgttcgatccaaagagtatccaacgcttttaaaagaacaattcgcttgaagaacagctgctggaaactgtctggcatgaattgctgaatgtgagtcaaacgatctgaaatcagagctaataagaattttttgacggttcgtttattaaatttatccagtttctcgatttcaaaaatatcaaaattatagtccaaattattaaagatgaaatcaaggatcgcttgtttatttagattctctttcttagtgatgaattgattgattgcttcttccatgcatttgttgaagattttttctaactcaactggcgtgcctgtcatgatactgttcctcatgctgtacattttgtctctttgaatggtgatgattgagtcaaattctagcgttgtttgacgtccagcaatttcttgatttttgcgattgctttgagactgattgatcaatttattgtattttttcttttttaatggcttgaaaccattggctgatttttcttgttcagttaatagttctcgttcctgggctgcccatttaggtgcactttcaacaacgattttatcctccatggatacataaaaaatgctatcaccagggcctccttgacgtccggagcgcccccgcagctgattatcgattcggtcactggtcattcgttcggttccaactactaacagaccgccgttttcccgcgcgtcttgttcaagtttaatgtctgtaccgcgtccagccattgaagtggctactgttacggccccttttttgcccgcttctgagatgatccaggattctttggtcgctgttgtagcatttaaaaggttatgaggaattcgatgctttaagagaatcagagagtataaagtcgacattgagaccgatcctgtttcaatcagaacgggacgttcttggatcaaagcattttttactgcttctaaagaagccatgatctttgactgattggtaacatatacgaggtcctgatgatcttttcggcgaatgggtttattcgttggaatttcgattacgtcaatattataagtttcacgaaattcgtcagcgtctgttttggctgtcccggtcattccggataaaatcttgaattttcggaagagattctgataggtaatggagcccatggatcggctttccgtggtgatctttaccccttctttggcttcgattgcttgatgaagcccagcttgtagttttgttccgatcaacttgcgcccatttgcttcgtcaagtaaaagaatttcattgtcttccacaacatagtctttgtttaagtgcaagagataattggcccgcaaggcaatgactaaatggcggtaaagatttttccatttttctgaaagaatgttttcgatacctaagtagtcttctgctttttgaatacctgtttctgtaaaccagacgtggcgcttattttcgctccttaggtagtctttcccttcaatcaggctctttacaaaccagtcagatagcgtaaaaaagttggactggactttgggagctcctgaaatgatcaatggtgtttgagccatatcgagtaatattgcatcgatttcatcaatcagtacataattgaagtgggtaacgtattgttcatctggagaaacggccaagttgtcaaacaagtagtcaaatcccaatgcgctatgggtagtatagacaatgtctgctgcatagacgacctctttgtcgacttcttctccttcatcttcatgttcggggactccagcagccacggttagtcctagaaaacgatagactttcccggtttcttcaatatcccgcaatgctaaataggtattggaagtaatcaaaaaatttcctttgcctcccagaccgtgtaagtacatcggcatggtggctgtcaatgtttttccttcaccggttttcatctcagcaacattgccataaaaaagagcaatcgcgccaagaatttggacaaaataaggttccattcctaagacacgacggtctgcttcgacaactacagcataggcttgtgggagtatactctctaacttttttcctagttcgagttgttgacgaaaaagaatagtttgcatttgtaattcttgatccgacaattgccgatacttgtctgcgagattttgaacctttctcgctaaccgcatatatttgcgaaattttttatctttcatttttgctgatccttccccaaaaaattgatagtgttagcagattaatttgtgttactggctaatttagcacgaatcattacgtcctctagttcaaaaagataatcccgcatcaaatcattggcttctaaaaaaaagacgatttttcccttcggagcagctagtttcatttttttggacgcaataagtggttccttgttttgatcaagcaacgcttcaccagaacttgttacgaagtgaagggaaaacgtataggttttggtggtgtccatattatagtagggaaattccccatgatagatggactcttgatcagctacctccaaagtatcttcagtccgtaaaacgacagctttcaagtctaatctaggactaggttcattgtcaggagtccttgattctgcagtctgtgtttcattattcgtcaaagtatctttcaaaaaaaagatacctcctaacagcaaaacaagaggtatgatgagttcaattagtttcttcatatgaaatccttctttttggggatgtttctacggaattttctccccttttttttccaatcctcgtcattctcagatgatcatctaaaaatgaagcgttgttttcttatttgaatttaaaacgatgataccacaatgactaacaccaccttttcattttttttttcgtttcaacaaaaaaacaaataaaaaagggggatttaaacttgctattattttgttaatccttacagatgaaaaaagtaagaaaaattggagatgaaaatgaagaatcaaaaagaactcattcgtaggatcatcgcgagtttcttcctgttgttcatcgttgagataggaaagcatattccgattcctttttttatttcagaaaagataccagaggaatcaactagcttgattctgaaattcttagcaacatcaaccggtggaaatttcactgttccaacgcttttttctttaggaatgggaccgtatatgactgctctgatcatctggacaacgatcagcatgattgatacagaaagtatcggaaatctttccacaaaaagaatcggctatattcaacgttgtttgactcttttatttgctgtccttcaaagttgcgcattagtgttaaaatttcgttcatcaatgatcgatcaaaaagctgttgggggatccgttgtcctgttgtttttaggagcagtccttattttgactgctggaggattgttcgttgcgtggctagccgatatcaatatcgacaaaggaatcggtggtcaaagcttgtttatcgttccaggtctattgatgaacatcccagctatgttaatttcgggacaaacagaatccgtccacttgagtcaaaattttatgattggtttggttatagtgactttaatctttatttatctaacgcttttcctttacagtgcagaataccgcatcaatattgaacggacaggtattgatagtcgcttcaacaattcgtatattcccattcgtcttttgcctgcaggagcgatgccgtttatgtttgcggtaaccgtcttttcaatgccgcagcttttactcttgaatgaaaagtggggagacacaggcttttcgaattttattacgacttacttttcatttaataatgtgcggggtgttttcacttatggtctgattctctatgttttaggttatggatttagttttattaacgttcgaccttacgatatagccaaaaatcttaaagagacaggagactatattttaaatattgcacctggtaaacagacggagatatatatattgaagcgattatctacggttgcattgcttggcaacagttatcttgtgatcatttcaatgattccgttattgattgggttgcaaaatcagatcatttccaacttagctttttattttggaagtatttttatgttgatcattattttagaaactatcacaaatgaaatacgcttcctcttttccagacgcacttaccggattttttagaggatgttaggaggtaattctttgaattattttattcccgattggacgaccagcagcggcaatttagaaagtgactacatgatgaatgtcattcagcttttcaagaacaatcgagaaccgtaccacttattgttattggaacatatcccgtttttgcgctataaaatgcatgcgtatgggttagaagcagctcagatgacttcgctttacgatcgcttgcaagatattcacaagatcaatgggtttcctttagatgtagatgacttgcctctttctcacaatgtggagaaagtctatacgccttttggtattacgttgatcaaggaagatcaaccatttggtaaaattcgtttcaatgcttttggctttgcggaacaaatgtatttaatgacggacccttaccgacaaattctcttcttcgatgatcgaggatttatttctgcaaaatcattgcagacagacaatggggaacaagtaaagaggatttactataacgaatcgggaatggaaaaatgtgtggaatactttggagaaaatccgcatgttgagctgattgattctcaaagaattggactaaagaaaagtcagtatcgaagtatggaggatcttctcttagaaatgatgaatcaatttcaatggaatagtgaatccgaagatcaactgatctgtttgacaaatgagcggaatctgcgattggtcaaaacgaatgagcaacgaaagcgagtgattcagatcgtttctgatgctcaccaactttcaaagtgtgcaccagaggaaaaagcagaattgtgggcagccgaaaataaaattattactgattccactagtaatcaaacagcgctcttgtctttaatgagacattccggtgtcaatgacccatctcgtatacagcgcatacctatttacacaacttctttccatctaggcaatagcaactccattccgcagctggttctttattggaacgccggtgagcttaatgaagacgttctgagaatccatcacttattgctgcaaaaagtcattcaaaatgatcgttatgacttaattatcgaaacgacgacattccaaagcgaagtcgttttacgtgaagcacaaaaagaaatggttgatactcactttggtgtcgatagtgaatctgaggagtatcagaaggtactgaagtattttgaagcaaaaaaagccaagaagttatttaaaacagatgaagaggcgattgaagagattcgagaaagcgaaaactggagaaatctggtagaagtagttgatgtcaacttcaggattcactttcgattggattctcacctcacgacgattcgacaggattttaatgagacacgtttgtatattgatttgtctgctgaagttgatgtgcagaaacaagcattggcagtaagcgcaggaattcctcagctcgttcggaagaaaaccgattatgttgatgaccaaaagaatgggcaaatcattggtcaaatcagagacctagatccagcaattgctttttatatggatgatttaaacaattggaaccaagcactagtagaaaatatcagttatattgaacgatttagcgaagaaaatgtcatcaaacaatggagggatctgctctatggcgtcgtctaaacaaataaagatattccatattgcggctgcagctgtttcttcagagtggcaaaaacagctttcttctttgtttgtttatcaatggcttccgttagcctatgatttcagaaaagatgagcaggaactgcagctgttcgagaaagacaaatataacagcaagtaccatcgagccctttttctactagagaaagatgcgttgattcttgaagacaaggagctattggaacaactgccagcctatcaaatcttttacgaaaaaaactgtcagctgtctcccgaagttcaagcgctcttcacattaaaagcagcaaaactgtttgatgaacaacagttggaaaatgtttttagtagcatcaatgaacaattttcagcgaagcagcaaggatataagttatcgatggatcacatgaaatttaataaagatgtatcgttgcaaatcactaaagaaggacatgcagcttgtcaggtaaaggcacaattgacaccagattatcagcaaatcactacttggaaaatgacgaacctgatccctaaagaggaacggacatgtttttatcccgagatcgcaaatatccaaggagaggcgatactgaagatcaaactttttttcatcaaagaaaacacaaatcaggtcattcaagtgattgagatcgcccacgatcgcatcataaatggggatccgatttacttcaaattggatcaacaggcatacatcaacgtttcattgtatgccaaaggaaatcaaggacaatttacgatcggacaaatgcacttgcgacgagcaatggcagatgaaagtgtcatgattccagggggcggccggatccgggatgatgagcatctgggcggagaagtgatctattactttaatccaggagacctaaaacctccattagcggtttatttttccggatatcgctctgctgaaggattcgaaggacgtggaatgatggggagcatgggctgtccttttttgctgattggtgacccccgtctagaaggaggaaatttctatctaggcagccagaaatttgaacaagaaatcgtaacaatcatattagaaaaactagcattgttgggatttcaaaaatcggatctcattttgtctggattgtcgatgggcacttttggcgctctttattatgcgagtgatttgagtccaaacagtgtcatcgtggggaaaccgttgacgaatcttggatctattgcactcaatgaacgcatcaatcggccaacaggatttccaacttcattggatatgctgctttacaatattggctttgtttcagaagaagcaagtagtcaattgaatggacgtttctgggaaaagtttaaaagtggagactacaggcaaacgacatttgctatcgcctacatgaaacaagacgattatgacatggaggcatttccaatgttatttgaatttctaaaaaacaattttcccatgactcgtgttctatataaaggcatgataggccgtcataacgacaatagtcccgctatcaacaattggtttttgaaacaatacaagaatattcttgtgcatacatttcatcggaatatcaagaaaattttataagaaatgggggagtcgatgaatcgcatgtaccgtatcaagtgggggatcgactttaatgataattacaattatggcgcaaaaatagcctacacatcctctggtgacgtcgcttattcttcacctctgatgcctcctggcgtcagtattaagtcctggtattcgaaaacagaatttcacagtagtcgaaaatcacctatgttgccgatgttgctgcctggacacgagtacgagttaacacttcatgctgaattcgatcgtaaagaagcagtccagctgctggtggaattttttgataaagacggcttttttcttgaaaaactggtcttcgaaacaactcaagagagcttccgttttccacaaaacgccactgattaccaaattcatatggtaaacaaaaagcaccaacagattctttttaaggaattggttttatctactaaggagaaccaagctttggcggtggttcctataggagcaaactcaggaacaaacattgttgcagttactccgttggtgggggaaagtgctgcattatcggtcgtattcgaaaaacagaatagttatgtcaaagaatattcacttcctgattgtgaagcgggattatttattgaacccggtgttacggctgcttcatcgtttttggaagttttgcttgaacaaatctatcagcgaatcgataatcctgatcaaatcacccttaaaatgggacaaaatttttctttactggaatcctgttatcacgatgatttttctatactggctttattatttgcaaaaccaaacaaagaaactgagtcaactgagcttatgcatcgtttgcagaaaaaaatcgtacttaatcgaagggcactgaatgtattagaaaatttaaaagaaaatagaaaaaaatcaacctaaataaaagggggacatcatgaatttttttgtaaataaagcaatgggaatcggcaattctggtgtggaacatgcacagttctaccgtgctgcttgttttgatagaaaaaatattccgtataaatatatttttatggaattagtaaagaatcttcatgaagcgatggcagcttggaagataccagacaataaagtcatctccatgtgggaatattttgccctagaaggtgactatttaagacaaggagctaaagcgaattttaccgcgaaacaggatctcttggtagacgccacgaacacgcataggattaaagaaaccatcacatcatcaggattgaaaatcgttgagcacatggaaaaatcccctagccgaaaaaaagaagggttattgctagtttcagattatcgggtagagatttttgactatcgaacgaatcaaagaaaaatcatgtacagctatcgcaatgatcctcatcgaggaagagtgatgacgaatattcacttgtttgcttttaagggcaaacatcgcttctttagaaatgaagtcttgctgcaacgctttttctttaaacaattgatggaagagttcccagaaaccaaaactatcatcattgatcgaggagaagaaagtgaggccgccttatatgatcattgtcctccagaaatcaaattgatcgaaatagtacatgctgatcatttatctgatcgtgatgtacctcgtgcgcctctttggaacaattattatgaatatgcattgacgcatttagagcaagttactcacatcgttgttgcgacagaattgcagagacaagatctactgatcgattttccaaacgaatccgaaaaaattgtgacgatccctgtgggggggattcgcgatatgacagaagaatcatttgaaaaaggcaaacaacaggcggagaagtttgtgacggtctctcgcttggcatctgaaaagcacattgatcttgtgatacgtgcaattgctgcagcaaaaaaagaacatccaacgctctctttagatatctatggtcaaggcggagaagaaagcaagttgaatgcaataatcaaggagctaaatgcagaagaatatattcaattaaaaggccactcccatgcgatcaatgaggtatatcccaattacgatgcctttatttctggctctttttcagaaggatttggattgacctatatcgaagcattgaatgcgggattaccaattgtgacgtacaaggcacgttttggggcgatggagttgatcaaagaaggggtcaacgggtatttgaaagacttttccagaaatgatgatacctacaatgtccagcaactaacagaaggaattcgtcagttagtcgctactgatttaaaccaacttaaagccaacacccgcaagtctgtccggatgtttcaagactcgataattgcagagaaatggagtgagttgatcgatgcattatgaattagtcactgtgatccgacccaatgaccggatatggatgacacaaaaatcacgaatcaaagaaggaaaccaagtgttgtctatctcaccaagtccaaattttcaagcgatgcttcaaaaagaagcggtgcagggaataaatattttagatcaagtcacacaacggagccacgatccagaaacctttttattttttaaccaagtcccaacggcttattgtacagaagtctatatgaacgaagatcgtaccatttcgttgattacagacggggatgaaataggcaaagtgagcttataccctatgactagaagacatgtcaaagaggtacggtacttctatccggatggtacgatagacttcattgaagaatatgccgctgacgggaaattgttctcaactatttattattgtaacgatcaggtccaagagattgcttttttcaatgatcagcagcaaagcatcttgaattattacttttatcagggagcaatcaacttggtcacgattcgtgatactgcaacattgaaggtaacccagaaatttaatacaacacttgatttcattcgggaacagttagctttgcggttaacagaaaatgataccgtgggaatttcatacatgggattagaattgttcgctttagcaacatctaattcaagaaataccctgtatctagaagagtcgcctcttgatggcaaagggaatatcaaaggaaatttaatgagtattttagatgatcacatcccttacatccatagggtggaagtggatcagaagaattatcaactattggcaaataagaatgtttgcatggacaaagttgtcttgaaaggatgaagacgaaatgaagaaaatgaaggtcaatgaattgtatgagcaaatcatgtcattaatcaaagaaaacagcggatccatgctctcttttgagaatgagcaggaggaagcaaagcgcatcctgcatcaacaaaaagaattgattgatcaattgattcagatcaatcaagagatgaaagcaatgatcaataagtcagaaaatgacatcgatctaaatgagatccaagcgttaaaaaaacaattcaatgcgtcttttgagcagcaacaggaagagcaaaacagattgcaaatgatttatgaaaaactcttttctgcttacgaggttgaaaagcaaatgcttcggacgtatttcttgaatgaaaccgatcagatcattgatatgttgacctcaaccgtagaaagacaggatagcgaagtgagtcaattgagtcaagagctgattcatgaattgcgttcattagaagaaacagaagtagaagctaatacaggtgcagaggaaaacgaaccaacagaaaacgttgcagaaatgagtgagtcgctatagctggcaactgatcaaatccaatagttaaacactgtattcttcatagttgttagctggaaataaactggggagaggtgatttcgttggcaaataatcagttagataaaacgattcaagcaggatttcaagaagaacgagaaaacgtaagagatcactcggaagagaaaaaaaagggaaagctgtcaccatcgtgctttccttggttatgtcgatcgtgatccttggatcgttggtctattctttgttggaagcattacagaagtaaaaattggaaataggtcctgcattttagaaaaaaggatttgaaaaatatggaaactagattactaagcgtttgtcgattaatcagtacgatcaacccagacttaaagatacctgatacatcagtagttgctgtcaatattgatcgcgagaaattagaagaaatccgcaaatgtaaaggtctatctgttaagtcttttgaaagaaagattgggttatctcgctcacgatactataggtgggtacaatatgaaatcgacctgcctttcgaaatggttgttggaatcaagaaaatgttgagcatatcagataccgtattgttagacatgtttgctatgtcaacagatgaacaacttcatctattaagtgtactgatttatagctctttatcaacgaaagaggacatgttcgtcacctttctcaaagtcagaaaagagttagaaaaatttcgtcctgctactgaggataatgtgatgtttaaacttatgctggcctattctgacctcgtgttcggctgtatgaaccagaaagtcccacaagcaagtttagagatgcttgaaacattttttctcggaactgatttttatacattgtttgatagtctcttatatttggctacgttgcgcatcaaacatcgctatggattgcaatcctcttctttagaaaaacaaatgtttctgttagaaagctgtctattaaagaaaataaatgcaactgactttactgaactgcgaccagttttagtaggagccgtattggatttgtcggaatgtttggtagatatgcaacgctgtgaagatgccattcaattgcttcaacatgcgagtcgtttaatggaagaacattggcatattgatgtctacaatcaaacggttctaaagctagtcaaatatctgatccttacaaggaatacttcgcaagaagatccagctgtgcaactgttttccaaaaatttgaaaggtgcagaatggtgcttaccaaaagatgaagtgatgtttgtgcgagcaatgatggaaaaggagatggggcaagcgtgaatcggtgggtgacgacgatcattgaatcgaatgcagcagattcagtcaaaaaggcgaaagcagatgtttgtgacattgccaaggggatggattatcagcctttatatatttatcgttatatcgatgagaatgaagatgattacgcacttacctcgaggattgatggcattacagctggtgttgccaatcaagatatggtggtctaccaatatccaagctataatggtgcccatttcgatcggatgtttttacaaagaatgaagcaaagagggatctatacgatcttattcatccatgatgctgagatgttgcgagggaaagtcgactttgatgaagctgctcttttcaacgaagccacattattaatcgttcatagtcaagctatgcagacagctttagtcgaacgaggagtgatccgaaaaatggtccaaaaaccgttttttgactatcgacacaaggaagtaagtgtcagtcatgagcggccagaaaaacgagttgtctttgcagggaatttagcaaaaaccctttttttacagcaatggcccaatcgcactgaaattctcgtatatggtgaaaagaatgatcgcccttttggcgcaaatgtccattattgtggtgtatttgagcaagaagaattgattcgcaagatggagaagaatggctttggtcttgcgtgggatgacaaattgccagctggtggtgactatcaacagtacacgaagtataatgcgcctcacaaaatttcattgtatctctcattaggcatccctgtcattgtatggcaacaagcagccatagcagagatggtacagaaactaggacttgggattgttatcgctgggattgaagaaattgaccataaattaggtgagttaacagatgaagaaatgctgcgaatgaagaacaatgttctttcatttagttgcttactgcgatcgggaatatttactaggactgcactagtggattcagaagtaaaaatactcctaaacaaaggggcaaatcaagaatgacacaatcgatgatcacaaagaaattatccgcaatcgtccagatcagcgagctagaccagatgctagcagagatgaatcaaacgatcgaacaacgggatagtaaaattgagcgattaaagcaaatgatctcagaaaaaaaacagtccaccattgggtatcgcgatttttttattctgaagaactgtcaagatgagctgagagatctctgtcaaaaaattgacttgcagcgggtcaaagtcaatgatcttttggaacatgtacgcaatacaaaagcgattttcaacgatttgttttttttagaaacagaagtcaacgaacaggcgaagaaaatacaagaactgtcaaatgcattctttattcaagcggagacaaaagagtagcggctgaaacaacaacagaatgtttggggagcaagaaatcatgacaaatagggaagttaggaggattagtgtggacaaaatcattgcattagacattgatgaatttcgagtaggcgtcgttggctatggttatcaagatgtcagaagttctgtttattcagaagtcaaaaaaaataatctgcagtatcttttaggaaagaataatgaaccgacccactccaaaaacaaagttggggaacgaattcttctcgggggaagcgagcaagaaattacttggggcttcgacaagttatatagtcgacgttcgaaggcttaccaaacctttggaaatccattggcagccattggagaccaaaattttaagacatatatcaaaacgatactttcttatttagtagagaagagaaccttgattttcactgaaattgcaaaggattgctttagctgctcattgtgcattggcgtagcaacagaaagttttgaccagctggctgaaatcgagaggcaactggcagatgaattcgagacagtcgttaatggtacccactatcggatacgaatcgaacgagtaaaactgattcccaaatcgctggctgtgatttttgaaagtaggcgaaacgatattcatttaatgttaggcgttgaagaaattctggcgggattgacttatgtgtttgagattaatgatcattatctaacttgtgacagttatgaaaatggcgaactgatcaaaagtacaaaagttacagacggcttgtatgaattagccggcaacgtggtacaagcttaccaagaaaatgagggaaatcatcccacgctaacttttgatttggatgctggggtaatctacgatatgctggtcacaacgaagaagaacaatccatttattgtgacgatcaatggacgtcagaccgtcgatttaaccgaaatcgttaaaaaagagctgacggctttgacggatcaattcattgattatgtcaatagtgatcaggatgttcaatatgcggatacaatactgatccgggatatttctgcaggaacgatcaatgaaaacacagtgaatcaggtattagctaaaatggggctatcttgtaaagtgtttaataataaaaatgcgctgggaatgtatttatttggggaattgttctggcaagaccaaccgaagactttggctgatcgctttgaggatagccgtccatcagctatgaatcatggtttttcagaaccggaagtgcgtgcagaatctgcaccaatcgaagagtacgtcgaatcaactaaccaaattgattccgagctatcagaagttaccgagcaaaagagtcattatcgaagctcatctgtggaaacaatttttgcagaacagtcagaattgcttaaattcttgatcaatgatgacaaggagccttccatttagcaatgaaaaagagaattttgatcgataaacgatcaagattctctttttcttgtggttggatttttttgcttaaatccgatactcgaatagggcaagaattggtcatcggcaatcatctatcagccaaactgtcgcagatgaatgaaggatcattctgtgctttaatcttcttcggaggtttactccttctgattgctggtatcttcagctaccgtcaccgtaaaaaaaatctttggggaaaatcaatttatctggttcagaaatgttttttctcaaaggtttttgattactggttattttataaggacacctaaaatctgtttaaatttttggctcatttgctgtgcagatggtacactagagtcaagggagggatcctatgctttggctgataattgtacttattggactgattgctgggttatactatatttaccgaactgcagtcctaaaaaaaggtgtacgttattttgtatctgctctgatcatgcgcaataaccattggtatgaaaaagaaggcagaaaacaacttgttccttcgggacagcgatcacaggaagcaccttcaactttctggcaagaagggtccgaatgtacccttactgcaacggatgatgttctgttacatgcacgggtctttgatcagtgtgccaaaacatgggtgatttgtcttcatggctatcgcagttctggacaagtcgattgtcaagatgccgcggaacgcttgtggcaagccggacacaatgtcttagtgccagatcttcgcggacacgggcaaagtgaagggcttcaaatcgggttaggctggttggatcgcttagatctgattctctggatcgagaaattagttgaaaaagatgcgcaatgccagattttcttgtatggtcaagggatgggggccgcaacagtcctcttagcgagtggagaagtattgcctattcaagttcgaggattgattgcagacagcagctatacctcgatctatagtttgatacgagccaatttaccgcgtctttctggattacccgtcaaacggttcctgcgtatggcaaatcgttacagtaaacaattagtagggtacccatttctacagatctctgtcacacgccaactaggcagtaaccatttacctgttttatttttacatggttctgaagatccatttgtctcagcagaagaaacagacacattgatggaagcaactgctggggaaaaaaaacgagtcatttttccagagatgggccatcttcaagcggtcacagaaagtccagaatattggccgactattctacaatttatccaggcaacagagtaatagtgcatttgaatttttttaactagaaaggaatgtgaaaaaatggaaatcaaagaagaaaacaaacgttttgccttatacgatgacggcaaggaaataggagaaatcacctggcaagaggcgccagacgatgtgttggtggttgatcatacatttgttgattctgcgtatcgcggtcagaagttagcacaaaagttactgaatgcggtggtagaaaaagcgcgccgcgaagatcgaaaaatcatgccagtttgttcattcgctgtcaaagagttcaaagaaaaatcagaatatgatgatgtattggctcgctgaatttcggtagaaaatgattgagacaacagtcgtgcaacaacgatctttatgttgctgtacggctagtgtctttttttgttccgggatttagtagttgtcttgtttggatgcagggaacatcgccatagcatcaataaaatatactggaaaaaaggtcccgaatgtggtagagttaaaaagacgattctagcaagcaaggaggagctatcgtgtacaatatattattagcagcagtgattgtgatttctgtgatcatggttattacgattatgatgcaaccaagcaaacaaaatagtgctgccagcgcgtttacgggtggagcagaccaattgttcggtaaacaaaaagcgcgtggatttgaagcggtaatgcaacgttcaactgccattttaggctttgtatggatggtcttgctatttcttttggcctatttgtcatcaaaataattggatgaaatttggaacctctcggctgcgaggggttttttctttgccaaaaatcttatgaacgcatttatcgttgaaatcatcgaactatggtagaattggacgtgaggtgaaacgaagaaatgaagaattttaaccaaccaaaaccagtgtttgctccccacggagatcgggcagtgattttgttccatgcttattctggtagtcccaatgatgtgcggatgctttgccggtttttagaacaaaaagagtatactgtttatacaccgatgttttcgggtcatgggacaacaaaccctgaagatattttgaatcaaggaattcaacaatggcgagcagatgccaaagcagcgattgaatttttgaaagaaaaaggttaccaaaaaattgctgtgttgggattgtcaatgggaggcatctttgccatgaacagtttgacacaagcggaacctgcgctaatcggtggtgggctattctgttcaccgctctttgaaacaaagaatgatgtgccgcgaaattttgaaaaatatgcagaaatgattctgcaatactcttcttattcatccgaagagcagcaaatgattttggctcgcgtaccgcaacaagtcagagatcagctgctagaaattgaatcgattgggcaagaaacagcaactaatcttgacacgatcgatgtgcctgtttttcttgcacaagcaggaagagaccgtatgatcgatccccagacggtttttcgcacagcagcagcattgtctcatgtgccctacacattacagtggtatccacatagtggacatgtagtgactgtcggcccagaacgaaaaaaattagaacaagatgtttgggcttttctggaaagcctcgcttgggaagggtaaaaaatgaaagagacgattaaaacaaaaattattcagttcatggaagaaagccgcaagaaaagcttttccatggaagaaattgccgaagcattgcaactgcaaaaaagcgaggatttcaaaaatcttgttcaaacagtagccgcaatggaacgagaggggagcattctcttcaataagaaaggcaaagtcaaattgccaatgcagcgagtcttagttgaaggaacattccgagcaaacgaacgaggctttggatttgtgagtatcgatgaggaagaagacatctatattcctaaagaatcgactggctatgcgatggatggagatacagttgctatcgacatacttcatgctgctgatcctttttccgataaaggggcagagggcaaagtcgttgaaatccgcaaacgggcagtcacacaagttgtcggtgagtttacactctttgatgaagcggagatccaagaaacagacctctatggagtcgttcagccaaaagataaaaaaatgaatgagttaaaagtattcatcggtgcagaaggcgttcgtccggtagatggcagcattgtgatcgttgagatcactcactatccggagaaaggctactctaaaagcttggaaggactagtcaaaaaagtagttggtcataaaaatgatcctggaatggatattttgtcgatcgtcgtagctaacggcattccgacaaagtttgaagaagcaacattagcggaagctgatgcagttcctgatgccattgatccggcacaattcccagaacgtcgtgacctgcgggaacaattgattgtcacgatcgatggggcagatgcgaaagaccttgatgatgcggtcaccgttcgtaaattagccaacggcaactttttcttaggggtccatatcgcagatgtttcttattatgtgacagaaaacagtgccctagacaaggaagcttttgaacgaggcaccagtgtctatctgaccgatcgggtcattcctatgatccctcagcggctgtcaaatggtatctgctcactgaatcctcacgttccgcggttgacaatgagttgtgagatggaaatcgattcttcaggtaaagtggtcaaacatgagatttttcaaagcatcattcaaacaacagaacgaatgacttatcaagcagtaaatgaaatcttggaagaccaagagcctgagacaatggcgcgttatgcctcgcttgttccgatgtttaaggaaatggctgaattgcatcaaatcttagaagcgatgcgcgttcggcggggggcagtttcttttgaggatcgtgaagccaaagtattggttgacgaagcagggcatcctcaggacatccttcttcgcgaacgaggagttggcgaacgattgattgagtcctttatgctggctgctaatgaaacagtggcagagcatttcaacaaacgtcgattgccgttcatttatcggatccatgaagaaccaaaagaagaaaaaatgcggcgcttttttgattttgcttctgcgttaggaattgttgtcaagcagacaaaaggctccatcacgcccaaagatctacaaaaagtcgtggaagatgttgcagataaacctgaagcgatggtggtcaacaccatgctgttgcgaagtatgcaacaagcaaaatattctgaagataactatgggcattatggactggctgcagactactatacccacttcacatcaccgatccgccgataccccgatttgatcgttcatcggctgattcgttcatacagtacggatccgtcagaaagcaatcaagaaaagtgggagcagaaccttccagatattgctttacacagttcacaaatggagcgaagagcagtggaagcagaacgtgaagtagatgctcttaaaaaagctgaatttatggccgataaagtaggagaagagtttgacgggattattagctcagtagtaaaattcggacttttcgtggagttgccgaataccatcgaagggttaatccatattactgcattgaaacaagattacttccattacttggaaaaccacctcgcattagtaggtgaacgtactgggcaaacgtttaagatcggacaaaaagttcgcatcaaagtgatcaaagcggatccagagactcgcgaaatcgattttgaattgattgaagcagaagaagtcgtacgaatccaacagcctaaaaaaaagcaaaataaagaaaacaaacagcgaagacaaacctcagatcgacagaaaaaagaaaatttacggggaaaatctcctcgtaaaaagaaaaaaaacggaaattcaaaaaagaaacctttctataaaggaattaagaaaaagtaggagggatgaccgttgcctaagggagagggcagactaattgcccaaaacaaaaaagctcgtcatgactacacgatccttgatacgatcgaagcagggatcgtgctgcaagggactgagatcaaatcgatccgcaacagtcggatcaatctaaaagacggctttgttcgtatccgtaatggagaagcctatttgtataatgttcatataagtccctatgaacaggggaacatttttaatcatgatcctttgcgtacaagaaaattgttactgcataaaaagcagattgctcggttgatcggtgaaagtaaaaatacaggaatgaccattgttccgctaaaagtttatatcaaagatggttatgccaaagttttgatcggcttagccaaaggaaaacgcgaatatgacaagcgagaaaccctaaaacgaaaagatcaggaacggcaaattgatcgtgctcttagaaacttttaatcttctaagaagttcttttagaatcatttaaagtgtattgctttgagattagggaaaaatttggtagcatttaaggcaaaggtactgatgtaccaagcttttcatgaaatttcacgacagtgtttcaattaattttttttcgaattttggcagaaaaacttttttgtctaattttcttgaaaatactttgaaattttcttgtcgtggtggtatgataccgattgttatgagaggaaacgcattgtaacaccagatattttctggagatgacaggaaaagaggtgagaaagattggatgaaaaatcgcttatgtttcacatcggtccgatttggtttgatggaactgtagcaatgatgacaatcatttcttgtataattgtttttttggtggtgttcatttgtacacgaaatttgcaaatgaagccaaaagggaagcagaactttattgaatgggtcattgattttgttcgcggaatcgtagctgacaatataccaggatcgcaagtgaacaactttcatttgctgggtgtaacaatgtttctttttgtgtttgtggcgaatgaaattgggctggtcacaaagatcgtgacagctgatgatgtctctttatggaagagtcccacagcggatccttttgtcaccttgacacttgcacttatggttattagtttgacacatttctttggtatcaaaacgcttggtttcaaaaactttatgatcaattcttacttgaaaccagttggtttcttattaccattgaaaattatcgaagaatttacaaatgttattactttgggcttacggctttatgggaatatttttgctggagaggtcttgttagggttgatagcgaatatgttcacaagtctaggttggtggtcattgcctatcgcgatgccgcttgaaatgatttggattggcttctcattgtttataggcgccatccaagcctatgtatttgtcacattgaccatggtatttatgagccacaaaatcgtggcggaacactaatcaaaacaaacacttttaggaggaaaaacaatatgaatttcatcggagcaggattagcaattatcggagcagcaattggtgcaggttatggtaacggacaagtaatcgccaaaacgatcgaatcaatggcacgtcaacctgaaatgtcaggtcaattacgttcaacaatgtttatcggggtagcgctagtcgaagctgtgcctattttgggggtagttatcgcgttgctattagtcttccaaggctaaacgtgaaaaaggcagaaacgaacaatgcactcgtttttgcttttttaaatgagagaattactttcagaaaggaagagtcgttatgctaaatcacttggttctagcagaagtaaaaaatgctatgcttggcaatattattcttgtcagcggctcaattcttcttttgctattcttgttgaaacactttgcatgggatgccattagtagcatgatgcaaaaacgggaagaaaaaatcgccaatgatttggattcagcggaacaatcccgcttgaatgcagcgaaactggaaaaagaacgccaagaaaaattggccaattcccattcagaagctgcggagatcatcaaaagcgccaaagacagcggagaattgagtcgccaaaatattttgaacgagaccaaagaagaagtttctcgtttgaaagaaaaagctcactcagatatcacgcttgaaaaagaagctgcgttaaaagaagtcaaagatgatgttgcagatctttcacttcaaatcgcagaaaaaatcttgggccgtgaattgactcccgaaaatcatgaatctttaattaatcaatatatcgaaggattaggttcagtcaatgaaactcgataaatttactgtaggtaaacgctatggcaaggcgttgttcgaattggcgatggaagaacaacgagctgaagctgtttatcatgagttgatgacactacgtcagatttatcaagagattccgatgtttggccaaatcgtgaccgataatcgtttggatcttcatgaaaaaagaaaacttgttgatcagttatttaataactttgatggattagtcaaaaattttcttgagatcgtgtatgaatataatcgtatggacgacctattgctgatcattgatgagtatgaatgccgctatgacgagcagcaaggtttagtcagtggtacggtgaccacagcagttgcattgtcgtcaagtcaaaaagaacaattgtcgaaacaaatcgcacagacgctcggctaccagaaagcagtgctttcagaaaaagttgatccagccattttaggtggggtcatcgtggaagccaatcatcaagtgatcgacggtagtattaagagccaactggattatctgcgacaacagatcggcagataaacaagagataagaggtgaatcggatggccatcaaagcagaagaaataagtgccttgatcaaagaacaaatcaaaaattatcaaaatgaactttctgtagaagaaattggaacagtcacatacgtaggggatgggatcgcccgggctcacggattagaaaatgcgatgagtggagaattgcttgagttttcaaacggttcttacggtatggcccaaaacttggaatccaacgatgtagggatcatcatcttaggtgaatttgaatccattcgtgaaggtgacaaagtaaaacgtactggaaaaatcatggaagttcctgttggggatgccttgattggacgagtagtgaatccgttaggacaaccaatcgatggcttaggtccaatcgatacagataaatctcgtccggtagaagcagctgcacctggtgttatgcaacgtaaatccgtttcagaaccaatgcagactggattgaaagccattgatgctttagttccaatcggacgcggacaacgtgaattggtcattggtgaccgtaaaacagggaagacaaccatcgcaatcgatacgatcatcaaccaaaaaggtcaaaatatgatctgtatttatgtagcgatcggtcaaaaagattccacggttcgtgcacaagtagaaacattgcgccgttatggtgcgcttgactatacgatcgtggtatcagccggtgcttctcaacctgcaccactattatatatcgccccttatgctggagcagcaatgggtgaagaattcatgtataacggtaaacacgttttgatcgtttttgatgatttatcaaaacaagccgttgcttatcgggaactttccttactacttcgtcgtccgccaggtcgtgaagcttacccaggggacgttttctacttgcattctcgcttattggaacgggctgcaaaattaagtgatgaactaggcggaggctcaatgactgccttgccattcgttgaaacccaagcaggagatatctctgcttatattccaaccaacgtgatctccattacagacggacaaattttcttagaaaatgacctgttttattcaggtgttcgccctgccgtagctgccggactttccgtttcacgggttgggggttctgcacaaatcaaagcgatgaagaaagtggctggaacattgcgtttggacttggcaagttaccgcgagttagaagccttcacgcaatttggttctgatttagatgccgctactcaagcaaaattgaatcgtggacgtcggactgttgaaattttgaaacaaaaactgcatgaaccattagcagttgaaaaacaagtggttattttatacgcattgacgcacggattccttgacagtgtgccagtaaataaagtattagactttgaagcagaattgtttgaatacattgaagcaaatcaagcagatgtgtttgaaacgattcgtgcaacgaaagacttgccagaagaaagcttattagatgacacaatcaaagcattcaaagatattttcatggctgcaaatacatcacgtgtttcagcacaagacaaaatgtcaacaatgcaaaatgcataaaagaggtgagaatgaatggctgcttcattaaatgagatcaagcaacgaattgcctcaaccaagaaaaccagtcagatcacaaacgccatgcaaatggtttcggctgctaaattgactaaatcagaagcacactcaaaacaatttcaagtctatgcaacgaaagtgcgtgagatcgttactcaccttactgcgcaacaactctcagatcttgcagctgctggacctaaagagggcgtcaattacaacagtatgcttgttagtcgtcctgtaaagcgcactggctatatcgtcattacttcagatggcggtttagtcggtggctacaacagttcgattttgaaacaaatgatgacgatgctggacgaagatcatgctcaagatgaagaatatgttatgatcgccatcggtgcgacaggagcagatttctttaaaacacgaggaatcaagttagcttatgagttgagaaatctttccgatcagccaagttttgacgaagtgcgtaaaattgttaccttagctacaacgatgtatcaaaatgaagtatttgatgaactatatgtttgttataaccatcacatcaattcgttgacgagccaatttcgcgtggaaaaaatgctgcctatctcagatttggatccagaagaagcagaaagctatgaacaagagtatttgtttgagccttcaagagaagcaattttggatcagttgttgccgcaatatgctgaaagcttgatttatggtgccattgtcgatgccaaaacagcagagcatgctgctggaatgactgcgatgaagacggcaacagataatgccaaaaatattattggggatttgacgatttcttataaccgggcgcgtcaaggagcaatcacccaagaaattactgaaattgttgcgggggcatccgcgttagaataatttcgagaacgaatggaggaatacgaatgagttcaggcaagattgttcaagtcattggtcccgttgtcgacgtggaattctctctagaccaatccttaccagatatcaacaatgcgttgatcgtttacaaaaaagacgagaaaaaaacaaaagtagtattggaagccgctttagaactaggggatggtgtgatccgcaccatcgcaatggaatctacagacggtttgcaacgaggaatggaagtcatcgatacaggtgcctcaatctctgtccctgtaggaacagatactctaggccgagtatttaatgtactaggcgatactatcgacttggaagcaccattcccagaagatgccaaacgtagtggtatccacaaaaaagccccagatttcgatgaattgtcaacaagtacagaaatccttgaaactgggatcaaagttatcgatttattagctccttacttaaaaggtggtaaagtcggcttgttcggtggtgccggtgttggtaaaaccgtattgattcaagaattgattcacaatatcgctcaagagcatgggggaatttcagtatttaccggtgttggcgagcggacgcgtgaaggtaatgacttgtattatgaaatgaaagaatcaggcgttatcgaaaagacagccatggttttcggtcaaatgaatgaaccaccaggtgcccggatgcgggttgctttgactggtttgaccattgctgagtatttccgtgacgttgaaggtcaagatgtgctcttgtttatcgataatattttccgtttcacacaagcgggttctgaagtatctgccttgttaggccggatgccatcagccgttggttaccaaccaactctagcaactgaaatgggtcaattacaagaacggatcacctcgacaaaaaaaggttccgttacatcgatccaagccatctatgtgccagccgatgactatactgaccctgccccagcaacagcattcgcccatttggatgccacaacaaacttggaacgtaaattgactgagcaagggatttatccagcggtcgatccattggcttcatcatctagtgcattagcacctgaaatcgtaggggaaaaacactatgaagtagcaaccgaggttcagcatgcgttgcaacgttatcgtgagctgcaagatatcattgcgatcttagggatggatgaattgtcagatgaagaaaagactctcgtagcgcgtgcgcgtcgaatccaattcttcttatcacaaaacttccacgtagcggaacaatttacaggacaaccaggttcttatgtgccagttgaagaaaccatcaaaggatttgctgagattttagaaggtaaatacgatgatcttcctgaagaagccttccgaagtgtaggtcgaatcgaagatgtaattgaaaaagcaaaagcactaggttattaataagcaaccatagagaaagaggggaacctcatggatcaatttttaacggttaatgtggtgacacctgctggtttggtgtatgaacaccatgccaaaatcgtggttgcacgaacgacagatggagaaatcgggatcttaccgcaacacgcgccgatcatcgtgcctttggctatcgatgaagttcgagtgaaacggatcgattccgatactcacgtcgattggatcgctgtcaatggcggaatcatggaagtgcgggacaatgtagtttcaattgtagccgatagtgctgaacgtgatcgtgatatcgatgtttctcgtgctgaacgtgccaaacagcgtgccgaaaagcaaatcgaagaagcaaaacaagtggaagatatcgaccaaatacgacgtgcgactgttgctttgcatcgtgcaatcaatcgaatcaatgtgtcaaaacattcctaagcgaagaccagtggtctttgcttttttttatctcaaaaacgttttaaagtctttttaaagtcttccaatgaaagtttcaagaaagaatattttggctcttttaaattttgtggtatgatagtaacgttcagatgtgaaaaggagaatcgaggatgcaagtttatggagtagatgcgattattcgtatcgtcagtcatttagcatttatctatttagcgttttgggcgttgcagtctttgcggatcgatgctttttttaaagccttacaaacgacgcaaatacggatggtcatggtctttttagcaattgctttaggctatactgctagcacttttttccttgaactgattgcattatgccgtaatttatttttaataggtttttaagaaattcaataatacatgcaggttgtgcgattgtatgctataattgtcaagattttgtgtatgattcaactgcattatttggagggaacaaaatggaagagattatcgttcaaggtggtaatcgtttaattggaactgtcaaggttgaaggtgcaaagaatgccgttttacctattttagcagcaagtttgttagcagaagaaggaacaacgactttagagaatgtaccgattttatctgatgttttgacaatgaatgaagtgatccgtcatttaaacgtcgagattgcttttgatcaatcaaaaaataccattacaatggatgcttcccgcgaattagctattgaagcaccgtatgaatatgttagtcaaatgcgtgcatcaatcgttgttatgggacctttattagccagaaatggtcatgcgaaagttgcaatgccaggaggttgtgctattggcaaacgaccaattgatctgcatctcaaaggattccaagctctgggagctgaaattattcaaaaagatggctacatagaagcgattgctagtgagttaaaaggaaatacgatctaccttgattttccgagtgtaggcgctactcaaaacatcatgatggcagcagtcaaagccaaaggaacgacgatcattgagaacgtcgctcgagagcctgaaatcgtagatttagcgaacattttaaataaaatgggcgcaaaagtctttggtgctgggacagaaaccatgcgcattgaaggcgtcgaccatttgcatgcggtctctcatgcgatcgtacaagaccgtattgaagcaggaactttcatggtagctgctgcaatgacagaaggcgatgtgattatcaaagatgcaatttctgaacacaatcgtccactgatttcaaaattaactgaaatgggtgctaaaatcactgaagttccagaagggattcgggtagttggacctaaaacaatcaaagcaactgatgtaaaaacgatgcctcatccaggtttcccaacagatatgcaagcgcaaatgacggcgattcaaatgttggctgatgggactagcatcgtgaatgaaacggtttttgaaaatcgcttccaacatttagaagaaatgcgccgtatgaacggtcatgttaaaattgacggaaacatcgctgtgatcgaaggcggccacgaattacaaggcgcgctagtttatgcaacggatctacgagcggcagcagctttgattttattaggcttgcgttcaaacggattgactcgtgtccgtaatctgaagtatcttgaccgtggctattataaattccacgaaaaattgcaacagttaggtgcttctgttgagcgggtaacaacttctgaaaaaacagcaccagtaaccgtttaaagaggagatgcgaccttgaagcttaatcgatatattttaactagtttggtaaaaattttgttggttatcttattggcgatcctgctctttattgccggcactatgatcggctatggtatcattggagacggtatgccgttaaaagtgttctcgcctcatctatggaaccatatattggacttcatgaagtaaacaaagctgaaactagaatggagcacattgctttattctagtttttttcaattctataaatagaagagagaggagtatgagatgtgagcaagcttttgattggatttgttcggctgtatcagcgattcatctctcccttatttccccctagctgtcgctattatcctacgtgttcgtcctatatgattcaggcgatccaagtacatggggcaggtaaaggaagtttgatgggaatctcgcgaattttacgttgtcatccgtttgtaaaagggggaatcgactacgtacctcagcgctttacactaaaacgaaatacccaagatcaggagcagcctacttatcactatcgcaaaaaataaacccttcaaactgcaggggtaggcaggaatgaacggagtaaaggagcaaaacgatgattcgagctttatcaccaaaagaatctttgccatggccgctattactggatgctgatccagaaaaagaagcggtagatcgatacatacaagccagtgagattcttgtttttgaaaatgagcagcagatcgtaggagtgattgtttatcaactgcaaacagcaggatgggaaatcatgaatgttgctgttgcaccggaagcacagaatcaaggaatcggtggtcgtttactgaccgcagcgttaagtaagattgctgcaacaaaaactacggaaactctttgtgtaactatcaaaactggtaatcttccttccgcagcgttaacactttataaaaaaatgggtttcattgaaaaaaaagtagtcaaaaactattttgtcgatcattacaaagagcccatttatgagaacggcattctacttactgatcaagtgattttagagaaaattctctaaaaagcatctcgcgcactttgacttcatttgaaaaatgggttttgtccgccattcatgttactctgaatcaaatcatttagagcgcgttattgtccttttcaacgaaatcaacagaaatcgctttcttaactgaggaaagtacagtaaaataagggagacaactgagtgagaaaggaatgttgagatgacattactagtatttgatatgggcggttctgcagtgaaatatggattatggcaggacgaacaattaagtgacaaaggacaatttgcgacgcctgatacttggcaaaaaatgaaagaagagctcaaagcaattcgagatagcattaaaaaacctcttgaaggcgttggcattagtgcgccaggagcggtgaatgttgcacagcagcagatcaatgggatcagcgccattccatatattcacggatttaatattttcgctgaattggaagcgttatttcaattgccagtcactattgagaatgatgccaattgtgccggaatggcagaattttatcaaggcgctgggaaagattttgacacggcagcattcatcgtgattggtactggggtcggcggagcactttttcaacaaggaaaactgatcaaaggcgcccatctttacggcggcgagtttggtttgatggttcttgataaaggcaaatctttttcgcagttagggacggctgttcaaatggcttggcgttattgtgaccgaatcggtgtggaccgcaaaacgatcagtggcgaggaagtctttcgtcgagcagaagaaggtgatattatcgccaaagaagaggtagacaaattttatcgctatttgactgaagggttattcagcatccaatttgcttttgaccctgaagtattgattattggtggcggagtcagtgcaaaagcaggattgttgccagaaatcaatcaacgaatgaagaaaatgctggcagcacaagacttaaatgactttgttccactgattaagctttgtgactatcgaaatgatgccaatctagttggagcggcagctaatttcaccgcacaagtgctgaattgattcagctcattgttgctgccattttttcaattttaaacataaaccttgaatcaacagatacacaagttgtgatcactttggaagagtggtcacaactatttttttcggaaatcgattacaatcgcgacgcatcaatctttattttttttaaaataatttaaagtatctgaataaagaaaatattctgataattcgttgacattttccctattattaagtatatttgataacatatccatgggagtaggggaggaataatgatgaaaaagaaatttgcatttttatttgctagtttatttttattatcggcttgtagtgcgggaccaactggtggttccactagcggtagcggttctgctagcggtggcaacaaacaagaaggtgatacgatcaaaattggtgtcaatttagaattatcgggtgctgttgcagcttatggaacggcggaaaaagaaggaattgatctggcggttgaagaaatcaatgagagtggcggtatcttaggaaaacaaattgaaattgtttcaaaagataacaaatctgacaataatgagtcagcgacagtcgcagccaatttaacgaccaatgataaagtagtagcaatgatcgggccagcaacttcaggtgcgacgaaggcggcattgccaaatgtcaccaaagcacaagttccgttagtgacaccttccggaacagatgatgcgattactgtcagcagtgacaaagttcaaggatttgctttccgttcttgtttccaagacagtttccaaggaacgatcttagcaaaatatgctgcagacaacttggatgctaaaaaagcaattattttaggcgataattccagcgactatgcgaatggattatcagcagcctttaaagatagctacaatggcgacattgtactcgaagagaatttcacagaaggtgacaaagatttccaagcggtgttgacgaaaatcaaaaatgctgactttgatgtattgttcattcctggctactacaccgaagctggtttgattatcaagcaagcccgagaattgggaatcgatcagccaattattggtgcggatggctttggtgatgaaaaaatggtccaaacagcaggcgcggaaaatgtatcggatgtttattatacaggacacttctcaactaaagctcctgccaatgacaaggtagaaccttttgtcgaagcattcaaagcaaagtatagcaaagaaccttccgcatttaatgcattggcatacgacgctgtctacatgatcaaacaagccattgaagatcaagattcagcagactcaactgcgattgctgaaggactatctgctttgaaaaacttccaaggtgtgacgggagagatcaccatggacaaaaatcataatccagaaaaatcagcagttgtattaggactaactgaaggtaaagaaacgtcagctgatacagtaaatccttaaatagaaggaccgttctttacacgatcaaatagggactgagacaaagtcgaaggtaagcgaacaaaatgatgaacgataaatgaaaaagtcgtaaatctgtgatcctatcaatcatggcagatactcatttgactcgttgctgcagacttctgtcgcggttcctttttcttagacaagtatcaagaatttaaggtattggaagtgaaaacatggaaatgatgatccaacaactaatcaacggtttatttctaggtagtatctatgccttattagcgttaggctacacgatggtttacggcatcattaaactgatcaactttgctcatggtgaagtgtatatgatcggcagttttattggttattttttgatcaatcaatggaatctgggcttttttcctgcactattcatctcaatgattgctagtgcagcgttaggcgtgacgatcgagtttctggcctatcgcccactccggaattccacccggatctcggctttgatcaccgctatcggtgtttcctatttattgcaaaatgtcatgatttttttcttttcaccagatgtccgaccatttccacaagccattgcccgcaaaacttatagtattggttttgtggaggtaagtaacatacaattattgattttagcagtctcattggcgttaatgatccttttacagctaatcgtcaagaaaaccagaatgggaaaagcgatgcgtgctgttagcgtggatgcggatgccgcacggttgatggggatcaatgtcaatcggacgatttccttcacatttgctcttggttctgcgttggcagctgctggtgggatgttaattggattgtattacaattcgatcgatcctacgatgggggttgtgccgggactaaaatcttttgttgcggctgtattaggcggtatagggatcattcctggggcagcattaggtggcttcgtgatcggactaattgaaacagttgctactgcattaggtttttctgattataaagatgctttagtctatgtcattttaataattatattgttggtccgtccggcaggaatattgggcaagaacctgaaagagaaagtgtaggtgtcagtgatgaaaaagaatttgaaatacaacattacttggttagcactcgccgctgttatctacttcggtttgtttgcagcttataacggcggattgatcaatctattttcagacgcgattatcgtcaatatcggaatcaatattattttagcagtagggctaaatttaattattggtttttcgggacaattttctttaggtcatgcaggttttatggcgattggtgcttacgcaggggcaattttaacagccaacaatcctacatttggcggatttctttctggtcttatcgtggggatgttcgtttcggggctgatcgcactagttgtcgggattccaacattgcgcttgaaaggagactacttagcgattgcaacgttaggtgtttcagagattatccgtatcttattagtcaatttacgaggattgacgaatggacctgcagggatattcgggttaccgcaattcagtaattggcaaatcgtctttctttttgctgtcggctccatcttggtggtctctaattttatccatagtggaccaggacgagcaacattagcgatacgagaagatgagatcgctgcggaagcaatgggggtcaatacaacgaaatacaaagtgattgcttttgtgatgggtgctgtcatggctagtattgccggtacattatatgcaagttatcaacaatcggtatttccgaaagattatggctttatgaaatcgatcgatgtcttgatcatcgttgtgtttggcgggatcggtagtacgacaggagcagtggtttcagcggtcgtattaggtatattgaatatgtacttacaaggcttctcagatttgcgcatgattatttacgcactggcattgatcgccattatgattttcaagccaagtggacttttgggaacttgggaattttctgtgaagcgcatctttgataaatttacaaaaaagggggatgacacgaatgcctctattggaagttaagaagctgactaagaactttggtggtttggcggcagtttcacatgtcgatttacatttagaaactaatgaactagttggcctgattggtccgaatggtgcagggaaaacgacactcttcaatctgctgacaggcgtctatgaaccaagtgaaggcgacgttcttttagaagaacaaggacaatccaagcgattgaatggggagaagccctatcttatcgcagctatgggattatcccgcaccttccaaaacattcggttgttcaaagatcttacagtgatggacaatgttctgattgccatgaacagcaaacaaaaagaaggcttttttacgagtgtgttgcggttgccaaagttttatcacaaagaggctgcaatgaaagagaaagtcatggaattattgcgtatctttgacttagaaaataaaagccaaacactagcaaaaaatcttccttacggtgaacaacgacgtcttgagatcgttcgggcattggctactgaaccaaagatcctttttcttgatgagccagccgccgggatgaaccctcaggaaacagcggaactgactaaattgatctaccgtatccaaaaagactttcaactgacgattttattgatcgaacatgacatgagtttagtcatggaggtttgtgaacgcatctatgtactggaatatgggcaagtgattgctcatggaaagccagaagagatcaaaaatgatccgcgagtgatcgaagcctatttaggaggggaactctaatgctgcgtattgaaaatttaagtgtccattacggcatgatccaagcggttcatgatgtttcctttgaagtcaatcaaggagagatcgtctcgttgatcggtgccaatggtgcagggaaaacgacgattttgcggacgatttccggtctgatccgaccctctaaaggcacgattctctttgaaggcaaacccatccaaaaagaagctccacaaaaaatcgttgctaatggattatcacaagtacctgaaggacgtcacgtttttccaggactctccgttcaagaaaaccttgagatgggcgcttttttgcgaaaagacaatcaagtcaaagaggactatcagcaggtcttcacgaaatttcctgtcctaaaagaacgactaagtcaagatgcttcaacgttatcaggaggagaacagcagatgttggcaatgggacgtgcactgatgtccaagcctcggttgcttttactcgatgaaccatccatgggcctagccccaatattcatcaaagagatcttctcgattatccaagaaatcaaacagcaaggaacgaccgttttattgattgagcagaatgccaaaatggctttgtccattgctgaccgcgggtatgttctagagactggcaaaatcgtcttgcaaggaagcgggcaagagttattggaaagtgatgaagtcaagaaagcctatctaggtggttaatagcttacaacaaggaggatgaaaaatgagtgtacgtgattttatgaccaagaatgtcatcactgttcattcggcaatgccaatatttgatgcgatagacttaatgaaaaaacatgacatccatcgattgccggttgttgatcagcaacggttagttggcctgattacagaaggcacgattgcagaagcaatgccttcaaaagcgacaagtttaagtgtttatgaaatgaattatttattaaacaaaacgactgtagcagatatcatgctgaagaaagtgaccaccatcaaaccggaggcgctgctagaagacgcgattgcagtcatgcgggaagaaaatgtcggtgtgttgcctgttttagcagatgacgaactagtagggatcattacgaataatgatatctttgatgctttcttgaagatcacaggttactatgagggcggtacaagagtagctcttgagattattgatgaccacagcggtgtcttagcggaaatcacgcagttattaacagatcatcaattaagtattttaacgatcgtggtcaaccgaatggctttgaaaacgatcgtagagattcaagttgaatccagacaagtgtcagaaatcgagaaaatttttgccaatgctgggtatacggtattgagtgcggtattgaccaatcaaaaataagcaaaaatcatgcaaacacaatcagtgattgcatgatttttttctggatgaatggttgactagatttgcttttgctttgcggtgttttctggtagaataaacaaggtatctgaaagaggtgagtatgatgtcgaaaaaaaataaagatattgaagtccgtgtggaagaaaccgttaaggtgatccaaggaaaagaatatgaagtccatcaactagtattagggaaaaaagtgattggtgaaattctcgcatccggtccgaaagaattccaaagctttctgggcgaagaagatttaggtgcaagccgaactttggatgcagcaattgaaacgattttgcgccaatggaacttacatgaataatttcttaaaaaaaatgacattttgctcttgcaatttgttatatttttaggtattataactgagtcaggttttttaaaagccgtttggaggagtagcgaagtggctaaacgcgacggactgtaaatccgttccttcgggttcagtggttcgaatccactctcctccaccattggggtatagccaagcggtaaggcaacggactttgactccgtcatgcgttggttcgaatccagctaccccagtcagtgaacaatcaagaaaagtcagcaagcatgtcttgctgacttttcttcgttatttatagcaaaattctaagggttaaaagttgaagattttttttatttacgataggctataggtaaataactcaggagatgagaagatgaaatttaaattgaatctaaaagaaaaagtcaccgaagcagctgagcatgtgtatgatgttgtcaaacgtgaagattatgctattcgtattgcaccaaaaggtatcaaagttacacaattgcgtaaaacaaaagatacgatcaaatggcgttcaaagaatcattgattgcgaaaagacattgagtaaaacagcccaataacaaataaaccggacaagagttgtcacccgtttcacgttttcctgatttctgagaggaagtactgggggaagcaactctggttcggttttttgatttatacgatatactctccttctcgtatgttacccttcgatttcgataccgagaacggttaagtgtccattggcgactaatttaatgaccagtttagctagttggtcaggagtcatttgactatcggcagtaagccaccagtgcagagtaccaacaaaaatcgatgtcatatattcaataacgaaatccagcggtacttcgatggagctttctgtaatttttaattttgaaaaaatatggtcatattgttcatagagaatctccgcgattcgttgccggactaattcgatggctgcgccatccatgatggtcagataaaaaaagcgattgtcctgaatgtgctgatagatttttgtcatcgcaagttcgactcgtttgatcttgattcgatttccctggactaaatcttcaagggacaaaatcgaagtaaaggagtcgattgccatatcaaaaattttttcatataaatcttgtttgtctttataatgagcatagaatgtcgcacgattgatcatggcttcgtcggcaatatcttggacagtcacttgatcgtagcctttatgctctacgagtcggataaaagcctccatgatatgtttattcgtgcgttgaacccgcaaatcaacttttttcatttttgtgaacttcctctcaatttaaacgacatttttaccgttcctgttgcttatcccacacatcacatgaatctgtttgttgaaatctcaatagattgttcttaaaatagacataagtattataacaaacagtttgtaagataatcaacaaagtgttggataaagcggaggcaccctatgaaaaaattaagtgctggtatcgatgtaggatcgacgactgtcaaaatggtggtcttgaatgaaaaaaagcagaccctctttgccaagtatgaacgccactattcggatatcaaaactgccacaaaaaaagttttactggaagctcaggaagtcatcggtaatcaacaggtcgcactagcaatcactggctctggagggatgggactggccgaagttttagcgatccctttcgtgcaagaggtcattgcctgtactaaaacagtcgagacactgattcctgaaacaaatgttgccattgaattagggggagaagatgccaaaatcaccttttttgaaggggcgttggaacaacgaatgaatggtagctgtgcaggtgggacgggtgcgtttatcgatcaaatggcggtattgttgaaaaccgatgctaatggtgtaaatgatttagcgaaaaattatcaaacgatctatcctatcgcttcccgttgcggggtattcgcaaaaacagatgtgcaacctttgatcaatgaaggagcagataaagccgacatcgccgccagtatttttcaagcagtggtcaatcagacgattgcagggttagctgctggtcgtaaaatcaaggggaaagtggcttttttaggtggccccctttatttcatgtctgaactacggcgccgctttgtggagacactgcaaattgctgaagaagacattatttttccagaaaatccccagctgtttgttgcgatcggcgccgctttatatggagaagaaacagctcaactcaatacattattagcccggttatcaaccgatgattcagcgaaattgcaaccgtctcacacattggcgccgctatttgctacggaagaagagctcgcagtttttagacagcgtcatggccaatcttcggtggaagaaaaaaaacttgcttctcatacaggagcagcctttctcggtatcgatgcgggttcaacgacaacgaaagtcgtattgatcgacgaagtgggtaggattctttactctttttatggcaacaatgaagggcagccattggaaaccaccatgcgggtattacaggaaatgtatcagcagatgccaccagctgtgttcatcgggaaagctgcggtcacaggatatggagaacagttgatcaaaaatgcactgaaaattgacattggtgaagttgaaacgatggctcattataaagccgccgaacatttccaaccgggggtcgattttattttagacattggcgggcaggatatgaaggccatgactatcaaagatggtgcactctcttcgatccagctgaatgaagcttgttcctcaggctgcgggtcctttattgaaacctttgcgcgttcgctgaaatacgaagtcaaagaatttgcgttagcagccactactgccaagaatccagtcgatcttggttctcgctgtacggtattcatgaattcaaaagtgaaacaagtccaaaaagaaggtgcatctgtcggggatatttctgcgggtctatcctattctgtgatcaaaaatgccttgtataaagtgatcaaaattcgtcgcccagaagatctaggtgagaaaatcgtctgccaaggaggaactttttataatgaggcggtgttacgagcctttgaaaaaatcagcggcagggaagtcgtgcggccgtcaattgctggcttgatgggggcttatggtgcagcactgatcgcgttagaaaattacgagattggtgaagtcacagccttgctttcaagtgatgaattgagtcaatttactgctgaaaaagaattcactcattgcgggttatgtgaaaataattgtatgctgactgtcactttattctcagatggacgcaaatttattaccggaaatcgctgcgagcggggtgcccgcatcaaaatcaaaaaagaagagcgcaagataaatttagtcgattacaaataccgccgcttgtttaagtatcgcccgcttcgcaaaaaagaagcgtctcgtgggcgtatcggcattcctcgtgtattgaatctatatgaaaactatccgttatggcatactttttttacagaactgggctttcgcgttgaattgtccccacgatcaaacaaagaattgtatgagaaaggtatcgagacgattccaagtgataccgcttgttatccggccaaaatcgctcatggacatattcaagcgttgatcgaccaaggggtcccattgattttttatccaggaattatttttgaaagaccagaaacagcgcaggctgagaatcatttcaactgtcccatcgtacaaagctacccagatgttattcgcaacaatctggatgatatccgtgctggccgtgtggattatcgtaacccgtttctaaatttggcagacgaaacttcaatggtcaaagtgttgtcagaagaatttcaagattttggtatcactgagacagagatcgcgcacgcattgcggcttggttttgaagaattggatcaatttaagctagatgtttgtcagcaaggggaaaaaaccttacggatgctgaccgaaaccaatcagcgaggcatcgtactttctggcagaccctatcatttggatccggagatcaatcatgggatcgcggaagtgattacccaagagggctttcatgtattaacagaagatagcattgcgcatttgggaaatgtcggtcatttacgggtcgttaatcagtgggtttaccattctcgtttatatgccgcagcacgggtcgtcgctaaaagcaagcagttggaattggtccaactaaactcatttggttgtggaatcgacgccgtcacaacagatcaagtagaagagattatggaacaatatggcaaattgtacactgtattgaaaatcgatgaaggggctaatttaggcgccattcggatccgtttacgttctcttaaggcagctgtcaatgaaagggagaaaaaccattttattcctactcaacgttttgaagaaccagccaagatcacatttactaaagaaatgcgtaaacaacatactttgttattacccatgctaagcccaatccatcaaagcgggttagtcgatgtggcactgcaagcttcgggatacaatgtgatctgcttgccggcggatgatcgagaagcagtcaatgtgggcctgcgtttcgtaaataacgatgcttgctatccagccattatttccatcggtcaattgatcgaagcactccaaagtggaaaatatgacttgcaaaacactagcgtattgatgacacaaacgggcgggggatgtcgggcaaccaattatatcccgctgctgcgtaaagcattgaacgaggcggggtttccacaagttcccgtcgtttcggtctccatgggaaatcaaggcgtggagtcaaatcctggctttaagtttacattaccaatgctcaaacgcgtggctgttgcatttttgtatggagatttatttgaacgagttgtttatcgaacgcggccttatgaagccatctctggttctgtagatcggcttcatgaaacgtggcttaaaaaagttgaaaaaaatgtacgcaacggttcttttactttgttcaaccacaacatgaaaaaaatcattgccgattttgatacgattgatctgcaggacatcgtgaaaccaagagtcggtgtggtaggcgagattttagtgaaatactctcctacagcgaataacgatatcgtgagacttttggaagcagaaggggcggaagcggtagtaccagacatggttggttttatgaattattcgctttataatcagatttggcgctatcaaaacctaggaatggccaaaaaaagcaaatggatcgctgaatttgccattggattaatcgaacggatccaaaaaccgatggaccgtgcgttgcgggcttctcagcgatttgaaggattacactcgatttatcaattagcagatgatgctagcaaaatcttatctattggtaatcatacgggtgaagggtggtttttgactggtgaaatgattgatctattgaaatctgatgtgactaatatcgtttgcatgcagccttttggttgtttgccaaatcatgtggtcggtaagggtgtaatcaaagaactgcggcaccaatatcctaaagccaatattgctgcgattgattatgatcctggagtctccatggtcaatcaattgaatcggattcgtttaatgttggcaacggccaataaagctttgcaaagcagcaactaacattcagcgctttaactatccaataagactgtaccaatttgagggaactttttttcttattttgtcttttgtaagaagaacagaatgaaaaaaaggatttttcccttaaattgacagtctttttagttttttcattggttatttaggtatataccagttataatagaaactgaatggaggaatagactatggcagagaacttacccgtatacatacagatacatgatcaaatcaaagcaaacatcgagaatgaaacctacaaaatcggtgaccgtttgccttctgagcgcgaattagcgaaacaattcggtgttagtcgcatgacattgcgccaagctattcagacactagccgatgaagggattttggaaagaaaaatcggatcaggaacttatgtggctcgtcagaaagtacaggagaaaatgagcggaaccacgagttttactgagatcatgcgctcacttggacgggtgccttctagtaaagcagtggcctacttcttgacagccccaagttcgagtgaaatggaaaaattgcaattagaaggacatgagacgattttacggatggaacgcattcgttatgcagatgatgtacctatttgtttcgaagtggcgagtattccagagaaattgatttacaattttagtaaagaagaaatcatctcatctttgtatcatgtgttagaagaaaagggcggtcataagatcggagctgcctcacaaacgatctcagcaatgattgcttcggagcaaatcgctgattacttgcaaatcaaacgcggggatgcaattttaagaatgcggcaaactacctgttttgaaaacggacaaccatttgaatacgtgcgtacacaatacgtagggaatcgttttgaattttatttagaaaaataagacaggaaatagaaaattatattgaccaaaatgaaagacaaaagtgaaagctagtaaacgaggtgaaagagtagcaagaattgtcagaaatgatgcctcaagcagattcatgaggcatcgcttgacagtagctatctgaacaatcattctgcttcaccagcaagtaatgacaacacaaattcgatctgtttctcaggaaatcggtcgttccacatagctgacagggccgtgtgcgatctctagttgtccttgtaacagatctgttagatcggcttctaccgcggacaaggatatttcgggaaccatcagcgttactcggattttatccgtatagtcaatggatgctaagtgaatgttttggtgctctaagtgattttgcagctttcctagctgaggataatcgatggtcaaataaagtgtctggttaagtgtcccttcaacgataccgatttcctttaaggcagcggcaacagtgcttgcataagcgcggatcaaaccgccagcgcctaatttcgtcccaccaaagtaacgggtcacaacagcaaccacattgattaattcattttttttgaggacatctagcatggggacaccagcggtaccgcttggttccccatcgtcgctgcttcgttggatctcattgttctcgccaataacaaaagcactgcaattatgattagccttccaatgctcttttttgagagcgaggatgaatgctttggcttcctcttcggaagtgacacgtttaagggaacaaatgaatcgggatttcttgatttcttgttcactttgtccatcctcacgaatggtgcgataactattcttcataggctcctccttttattttcagtataggtaatgtggagaaaagtttcaatgaaagaaatcagtaaagaataagtgaacggataaaaaaggaggcgttgccattgagtaaacgcaagaaatacgatatcatcactcattacttaaaatctaatggcggttctcaagtcacattgactttcacacaatttgatgaactgttatttccggcgacagggctgccaaagagtgcccgcaagagcattgattggtgggccaatgattatcgacatccggaaaacggtgcctatgcgtggttgaatgcaagatatgaagtggttcacgtgaatttaaagaaggaatatgttgttttcaatcaattggtcaagtccaattggttaatagacagtaagcgttgacaaatttgaaacttgttctatactaggaataggtaatgttatattatttaaaattttagggagtgttcgatatggctaaaaaaacgattatgttagtttgttccgcaggaatgagcaccagcttattagtgacaaaaatgcagaaagctgctgatgcaaaaggtcttgatacagatatttttgctgtttccgcttcagaagcagatcaacatttagaaagcaaagatgtgaacgttttattattaggccctcaagttcgtttcatgaaaggcgattttgaaaaacgtttagcaccaaagggaatcccattggaagttatcaacatggctgactatggtatgatgaatggtgaaaaagtgttggatcaagcattgacattgattggtgaataagcccaatccattttcaacgattacttaagactattgagtagaaccttacaggtttcgaatttctctgttttggcagaaaatgagaacgagtaaggttctttttttgtggatggcgtactttaattgtgtcgaatgtccaaggctttcgaaaaaactagcgaatgtacctgcttttgaaggcttgatcagtcatatataacgagaggagggatacgatggaagaaggcggtcgtcaaattttagtatccgaaagggaacgcaacaactccgaccaactcaaaggtgacattcgtccagccgtcttaatcaaagagggacaaattgaatgtcagcgttgtggcagctgcttcaataaagaggaggtacaactgccaacagggattcactattgccctgcctgcatccattacggacgggcagatacgtctaaagtttttgtgacagtttcggaacaaagcagcgtcagttttccgaaaattcattggcctggtccactaacggtttttcaaaaaagaatctcacaagcgttggtaagaaattatcaacaaaaaaaagcaacgttggtttggtcggtaaccggctctggcaaaacggaaatgatttttgaagtgatacaagcggcaaggctgcaaggacatcgggtagctgtcgtctctccgcgaatcgatgtgtgccgcgaactgttccctcggatccaacaggcatttcccaaagaatcttgtttactgctttacggagattcagaggaagactatcggtatacagacttgcttgtggcgaccattcatcaactgctgcatttttatcgggcatttgatctgataatcgttgacgaagtagatgcttttccttatgaaggggaccagcaactaaggttcgggttaatgaatgcactgaaagcgaccggctgtctgatttatctaagtgccacaccttcagatgcgttactaaaagaaacaacaaattttgcagtggaaaaaatgccgctgcgttttcatcagcgaccgctgatcgttcctcaactgatttggtatgaaggttggcgtaacgtgtatcaaacaaaaagaagactacggcgcttattgtttcatctgcaacgcctatctcaaacaaattttgtcttagttttttgcccaagtattgtttttatggaacggctagaaaaagctgttcgatcattcttaaaagaggagacgataaccagtgtttcagcaaaagaccctgctcgaatagaaaaagtagtcaaggcgcgcaattcaaagtatcagattcttttcacaactaccatcttggaacgaggtgttacctttgaaaatgtttctgtagtggtgatgggagcagatcatcctgttttttctaaatcagcactggtccagattgctggacgagttgatcgaaaaggtccattcaatcatggagaagttctctttttctatgatcaagcaacatcagcgattcgtaaggcgatcttggaaatccaagcgatgaatcgattagcaaaggagtggctggcaagtgaagtgtagctggtgccaacaggagtttgcacgagaactgtggctgcgggagattttatggccattaggaattcctgcttcagagaagtgtccagactgtaggagtaaattgcagtttgttgatttgactagctgctgcaagacatgttgtaatgaaagccaaaattgtcgggattgtcgctattgggggcaacgttatccaaagtttcagctacagcatcgtgctctgatgacatacaatcaaggaatgcaggagtggctccatcaatacaaattaatgggcgattttcgtctgcgagctacctttctcccagagatcaagcaagctttcaaaggattgctctatgatctggtcatcccgatccccctttctcatgaacgctatcagcagcgtggctttaatcaagtgacagcagtattacaagctgccgggattgattaccgatccttactaaagaaaaagatccatttacctcctcaagcagcaatgactagaaacgaacgattagcagctccacaaccatttattatcgaaaagggtcaagaaatcaaagacaaacgtgtgttgctggtggatgatgtgtatacgactggacaaacaatttatcatgctgcagaagtacttttgacttgccagccgaaaacgatcacgtccttttcttttgccagataaggaattgtaaacgcttaaaaaaatcttagcgattcgctttccaaatgcaagatacttcgatataatagagttaagaagaagaagagagtggtccttttccttcttagtgtggtagacgaaaggggtaatttttatgtttagatataatgtacgtggcgaaaatatcgaggtaactgaagcgatccgcgattacgttgagaaaaaagtaggtaaactagagcgttattttaatgatgtgcctgaagcaacagcgcatgttaatttgaaagtatataccgaaaaaacagcaaaagttgaagtaaccattccgttaccattcctagtcttgcgtgcggaagaaacttctcctgatctatatgcaagtattgatttggttgttgataaattagaacgccaaatccgtaaattcaaaacgaaaatcaaccgtaaatctcgggaaacagctttagtggctccagacaatggcgacttattcacaacggatacaaacgaagaagaaaccaatggagcagaactagacattgtacgtacaaaacgtctttctctaaaaccgatggatagtgaagaagccgttttgcaaatgaatatgctaggacataacttcttcatttttgaagatgccgaaacaaacggcacaagcattgtttatcgccgtaaagacggcaagtatggattgatcgaaaccgattgatcaaagaatgacttgtcgaaaatccccaaaaaagtcttttttgacagagcagagtgatctgctctgtttttttgaataaaaaagctgtgataaaaggggcagttaaacaaaatgattcgctgagtgaaataaaattgccctatcaatcctgcaggtgtaaatccgatctgcgggatcataggggcaatttcatggcctttcggctgctgtgtttgctaaagtctttttgacatagttctttgctgagaaatcaataaatcgttggtactaaaccaccgtcgagtctcaaggcggctccagagaaagaggatgcgtaaggactagcaacgaaagctacaaagcgtccaatctcttctggacgaatgagccgttgaatttgagacagtgggcgatgctttttcatgaaatcttcttcccacatggactccggcaaatcactttcttgatacatcgttttcagcatcgtttctacgccttcggtcagtgttgaaccaggcatgatcgtatttacagtgacctgtgtcccagcggtgagttttgacaaacttttagccaaagagaggttcatcgtttttgtcatgctgtactgcggcatttctccagaaggcataacggcttcctcgctggcaataaaaatcacacggccgaagttttgttggagcatatgaggcaaataaaattttgctaaagcatttcccgacaaaacattcacatggaaaacatgttcccaaacttcatcggtaatttccatgtaatccattggttcgaagatccccatattattgacaagaatatctactttagggaagtggtcaaaaagctgttggcgagctgctgcatcggctagatcatatggagccacttgaggattcgtcttaggaaatttttcttttaattcagcaacgaaagctctgacactgtccttttgccgtccattgacgatgacatccgcgccttcttttgccagctcgaaagcaattgctttcccaatacctttcgtagagccagtgaccagtgctgttttctttgttaatcctaattccatttccttcactccatttccttagttaaagttaaattgatccggatcgggacctacccggtgatcttcattcaaacgattaagttcacgcatatcttcttccgacaaagaaaaatcaaagagttgctgattttgttccattctgtcgggattaactgtcttaactaccagtaaaatatcttgctggatatgccagcgtaaggcgatttgtgcaggggatacgtgatggcgttgagccatctttacgaggattggatgttggagaatctgaccttgcatcaatggagaccaagcttggatcttgattccttgttgctgacaataatcacgcagttctttttgagctaattttggatgtagttccacttgatttaacacaggtttgacttttgctgtagcgagcaatttcttcaaatgatggctctgaaaattgctgacgccgatggctttgatctttccagcttgatggaggtcttcaagtgcccgccaagattcttgatacgcatttttgccaggccagtggagcaaataaaggtctaaataatccaattgcaaaagcgcgagggacttttcaaaagccgcgatcgtttcatcgtagctcaaataattgttccaaactttagaagtgacaaagagttcttctcgtgtaagtcccgttgctgctagtccttctttgatcccttggcctgttccgctttcattatcatatatttgcgcggcatcaatcaaacgataaccttttaaaatgccgttttttacaacagtagctacttcttcatcaggaatttgaaagacgcccaaaccaaagccaggaatgctgacttgttcgttcaatgtaattgtgtcggttaatgaatgaatcatataaatttcctccttgatttttggtaaatataccttatactaaaaaagttcagatgaatagtacctacttttttgtgctatagtgtcaaaaaagtaacttttttgaatttaaaggaagtgtttaaagtatgactccaaaaaaatacaacattggtgtggaagctactatggatgtgatcggtggaaaatggaaaccgattattctgtgtaatctgcgagatggcgccttgcgtccgagtgatttgaagcgacggatacctgatatcagtcaaaaaatgctgacgcagcaactaagagagctggagacagacggcatcgttttgcgaacctcttatcaccaagttccaccaaaggttgtctattctctcagcgactatggtctgacattaagcagcgtattggatgctctctgtcattggggagaaatgcatgtttcaacattgaaagaacaaggcgttgaagtagcgttagctagtcaagaggcgtagggaagatcaaaaacaaaaactagcaatcgtcgagtcgagagtcactcagcgattgctagttttgcttaaaaaaagtgaggtaggaagagggttatttcactgaaccggaagtaattccttgtacataatatttttgcatatagataaagagtagagtgattggaatagcgatcagcacacagccagctgtaaaggacataaacaacgaattggctgttgtttttgtcatcatagaataaagtccgatcgcaacggtatagtttttgacgtcatcacccatgatgattcgagcaaagatgaaatccatccaaggacccatgaaggccatcaaagaggtatagacgataattggttttgataacggcaatgtgatcttggtaaaaatatgccatttattggcaccatcgatcatggcagactcatctagcgccattggaatcgtatcaaagaaccctttggcaacgtagaatcccagtgccgctccagccgaataaaccaagatcagcgctaataagctttgtgttaggttgagggcttttagaatataataaacggcgatcatgctcataaagcctgggaacatattcaataccaaggcaactttcaagaaaggtttacgaagtctaaagcgcaaccgagagagagagtaggccattgcgattgtaataaatgtggacaaaagacagctgcagacagcaacaaacaatgtattcaagaaccagcggacaaaagggtagctgccgctatcattggctaatagttgtcggtaattttcaaaagtgaattctttgggaatgatataaggaacgaaggccccaccttctcctctaaaacttgtcaaaatgatccaaacgatcgggaataaccaaagaacagaaagaatgatcaaaatcgtataaatcagaaaacgggtttttgactgcccttgttggtagccggatttctttttctttacagacattgttacccctccttataagaatttgttcgcgtgtacgcaaacaggctaaagacagcagataagataaagatcaagataccgattacggaagctaaattgtaatccatcgtgttgactgtcaagttgtacagccacgttactaacagatcggtcgagccagcaccatagaaattagagttagatgggccgccgccagtcaataagaaaataacattaaagttgttgatgttgccgataaactgttgaatcaatgcgggcatcattacaaacaatatctgaggaaatgtgatggagcggaaaatttggaatttattggcgccatcgatttcggctgcttctagttgttcctgatcaagattttgtaagattcctgttgttacaagcatggttgctggaatcccgatccacatgttcacaaagataatgctgactttcgcaaagaaaggatcggtcagaaacgggatcgaagaagagatccatccccaattcagtaagagtgagttaatcggaccagaaccgtttagtaagttacgcatgatcaaaagtgacacgaattgaggaactgccatcgtcaaaacaaaaatggtgcgccacaattttttgtaacggatccctttcgcgttgatcaacaaggctaagatcacgccgaagaagaaacaagtgatcgttgcgagtacagcccatgtcaatgtccaagctagtactgggaaaaaggtggacgccatatcaccagtgatgacattagagaaattcttcaatcctacccaagtaaacagattttttgggggtaaatttttgtgatcataattggtgaaggcaatcgaaatcatatataagagcggtaagatagtaaaaaataagacaccaatcaatgggattgtcatcaatgttgcatgaaagcgttcgttcaccagactatgtaaatcgtcgcgtgtcgtagggattttaagtccttgttgttttaattcgtacaaatgacgggcgcttttcaaattaatgatatagagaataatcaagagtgcacaaacgagcagggaagcaataccgaaaagcaataagagcattgaattgtcacctttttgcaagatttcaataccaagtgcttcgttatagaccaacccttgtttttgtgttcctaatgtttgcagcatcagaagagcgtggaaaccatttcttatgaaccaagcgataaaaccaacttgtgatacgatgaaaataattcctttcagccattgtttattggcgaaattagcgcttcccatcaaaataaaagatagttttgtcgctagatcgccttttttgaataattctctaaaagtgatatgcgacgcatgttttttcctgaacatatcctctcaccttgctttcgtaattaactagaaaagggaaagcaggctttccctttgtcatgtatagtgatgtgttgttgattattcggttacttttgaaatatcggaaacaaacttatcgagtttatcttggaactgatctggtttgatttgacctttataggtatcgttgattaacgcatccattggtggccagaaagaaaccatctcaggcaatttaggcattacgacagagtgttctgcatcagacatttccatcacagcttttgctactgcatcagcttttactgcatcagattcttgtgcatctttatttgaagggacaacgccgttttcagtaaattcgatttcttgtgtttcttggttgcttaaatattctgctaaagccatagctgctaatggcgcttcggtttgttggttgacagcataaagttttacacctaagaaagctttcatttgtttcgcaccactgccgaagtcgatcgttggataggcggcaacacccatgttgtctccaagcgctttttctacgtcattttttgaccaaggacctgaaaggaaggcatctgatttaccagattgcaaatcagacaacgcggattcactggcttgaaggacaccgctattatttttttgatcggcgatccattgtaagacttcaacaccagcttcgttgttgaaattggttccattaatatcttcaccgtcttctccataaagaacatttccgttgctcataaatagagggccaaaaatgtagtttgcaccgtcttctgcaaagttggtaccgatttttccagcggaagtcaatccttcccaagtttttacatcatctgctgtcaatgtagaagtattgtaataaagcacttgagattcaacaccgtaaggatagccgtaaattttgtctttccaagtcacggcatcaactgctgcttccacgttcgtatctttgattgttgctgcttgcttatcaccgattggataaatcagaccagcttcagccatttgtcctacttggtcatgaggcatcatgaatacatcggctgcttgttcagggtcctttgagacgtctgctttggcatcggcagaagagccaactgcaactgttacttttacatcaggatactctttttcaaatttgtcgacttgcccttgtaaggcatcaatatgttcggtatctacccataatttaatatcaccttcgacttttgcactagactccgctgcactgccattgcttgaagcagcatcgtcgttgctgttgccacaagcgcctagtacgattgcagacaagcttaaaatacttcccccaataagtaatcgttttacatctaccttcattcttgttcctcctaaaaattaattgtttgcgtttacagacctaattatgcaatcgattgcaataatagtcaagcagaaaatgaacaacttttttggttttctattgcttataagaaaaattaagaatcagtccaacacaaaacctttctacaattggaatgataaagtcgaaattttcaggaaataacttagttattctattcacatttgaaaagcgaatgaaaatgtggcagatcatttttccgtccgttgtaaagcaaacgattgctttctgtttcagagattgttttaaggagcaagagaagtagagtttcttttggacacaagaagcaatgggcgtaaaagaaatctatttaaaacaattgaaaaaagaaaaaaagagttaaaaaaatcatggagaaacatgaactgcgccgaaaaatatttcctttatgatgaactagtgataaaatagttaggagagtttccagttaggaaaagtagaaataaaaggagaattatataggcatggccaatttttttagaaaattaatcgagaatgataaaaaagaattaaaacgtcttgaccatattgcttcacaagttgaatctcatgcggacgaaatggccgctttatctgacgaacaattgcgcgaaaaaacagatgaatttcgcggtcgttttcaacaaggtgaaacgttagaccaattattgccagaagcctttgctgtggttcgcgaagcggcaaaacgcgtcttagggctgtatccttaccatgtccaattaatgggggggatcgtgcttcatgacggaaatatccctgaaatgcgtaccggtgaaggaaaaaccttgactgcgacattgccggtttatttgaatgcgttaagtggtgccggtgtacacgttgtaacggtcaatgaatacttggcaacccgtgactctacagaaatgggtgagttatataatttcttaggattgactgttgggttaaacatcaattcgaagacagcagaagaaaaacgggctgcatatgcctgtgatatcacctacagtacgaataatgaactaggctttgactatttacgcgacaatatggtggtttaccgccatcaaatggttcaacggccattgaattatgccatcgtcgatgaagttgactcaatcttgatcgatgaagccagaacaccattgattatttctggacaagcagaaaaatcgactgcactatacaatcgggtcgataattttgtgaaacgattaaaagaagaagaagattacaaaatcgacatccaatcaaaaacaattggattgactgaaaaagggatcgagaaagccgaagaaacatttggcttggaaaacttgtatgatatcgaaaatacagcgttgacccatcatatggaccaagcgttgcgggcgaattatatcatgatccgcgatatcgactatgtcgtacaagaaggcaaagtcttgatcgtcgaccagtttactggacggatcatggatggacgtcgttattctgacggattgcaccaagcaatcgaagcaaaagaaaatgttgagatcgaagatgaaaccaaaacgatggctacaatcactttccagaactatttccggatgtacaaaaaactttctggtatgactggtaccgcaaaaacagaagaagaagagtttcgtgaaatctacaatatgcaagtcattcagattccgaccaatcgaccaatcgttcgtgatgaccgtgcagatttactttatccaacgctggaaagtaagttccacgcagtggtgcaagatatcaaagaacggcatcgtaaagggcaaccagttcttgttggtacagtagctgtagaaacttccgagctgctttcaagcatgttggatagagagaaagtccctcatgaagtactgaatgccaaaaatcactttaaagaagctgaaatcattctgaacgcaggacaaaaaggtgctgtaacgatcgcaacgaacatggctggtcggggaacagatatcaaattaggcttaggtgttgctgaattaggcggattagcggtcatcggtacggaacgtcatgaatctcgccggattgataaccaattacgaggacgttctgggcgtcaaggagacccaggggtttctcaattctatctttctttggaagatgatttgatgaaacggtttggttctgagcggatcaaagtgttcttggatcggatgaagattgatgaagaagatgccgtgattcaaagtaagatgttgtctaaacaagtagaatctgcgcaaaaacgagtagaaggtaacaactacgatacccggaaaaacgttttgcaatacgatgatgttatgcgtgagcaacgggaagtcatctatggtcaacgtcaagaagtcatcatggaagagcaggatctttcacaaacattgatgaatatggtcaaacgatcgattgaacgagttgtcgatagccatacccaattagaagaaagcaattggaattatgaagggatcgtcgactttgccggaaatgctttagtgcatgaagattccatctctgttgatgatatcaaaggcaaaaaaccacaagaaatcaaagactatctctatcaacgggcagaagaagttttcgagcagaaaaaagcccaattaaacagtcaagaacaattgttagaatttgaaaaagtagttattctgcgagtggtggatacgaaatggacggaccatatcgatgcgatggaccaattaagacagtcagtcggtctgcgggcatatgggcagaacaatccattggttgaataccaaactgaaggatacaacatgtttgaagatatggtgggagcgatcgaatatgaagtgacacgcttgtttatgaaagccgagattcgccaaaatgtacaacgagaacaagtcgctcaaggagaagctcaagaaactgaaacagtcccagaagaagatcctagtttcaaaaatgttggccgtaatgatccgtgtccttgcggcagtggcaaaaaattcaaaaactgtcacggcaaaaaatagaagaattgatacgttaggaaaaaggctggcagcttttcttgtccagccttttccgttcatttacaatacgcgtgaagaaagaaggaaatcaaatggaaatcgcagatatccggaatcaattgaatcaaatgaatgaaaaaataaatagttttagggggtctctttgacttagatcagttagaagaggcaatcgctgaagcagaacaccagatggcggaccctacgttttgggatgattctgagcaagcacagaaggtgatcaacgagaacaatgccaataaagaaacctatgatcagttcaatcaattggcagaagaatttgaagagttggaagttcttttggaaatgatccaagaagaaccagatgcagaaatggaagcagaactagcagaacgtatccaagctttgaatgaaaaaatgggaacttatgaactgtctatgctgttagatgaaccatatgatcgaaacaatgcaatcatcgaactgcatccaggtgctggcggcaccgagtcccaagattggggcagtatgttgttgcggatgtatactcgtttttgcgagcaacatggatatcaagtcgaaacattggactatcaggcaggagacgaagccggaattaagagtgtcactttgttgatcaaaggccataatgcttatgggtatttgaaatcagaaaaaggcgtccatcgcttagttcggatttcaccatttgattcagccaaaagacggcatacctctttttgttcggtagatgtcatgccagagctagatggtgcgattgatatcgaaattaatagtgatgacttgaaaatcgatacttatcgagcgagcggtgcgggcggtcagcacatcaataagacggagtctgctgtacgaatcacgcacattccaactggtaccgtagtggctagtcaagcacaacgttcgcagttgaaaaaccgggaacaagcaatgggaatgttgaaagcaaaactttatcaactagaagtagaaaagaaagaacaggaagctgcagcgcttcgcggagaacagatggagatcggttggggttcacaaattcgttcctatgtctttcatccgtattccatggtcaaagatcaccggactaactttgaaacaggaaatgtacaagcagtaatggatggtgatttagacggctttatcgatgcctacctcaagttgaaattaaatcaaaaataactatactgggctattaaacagattgaaatataattgtaatctgttgaaagcattgtgaaatatattcatgctataataagccagtatgaaaaaaagtgagatggagagatagctgcatgattgaaatgaaagaagtaatgaaaaagtactctaatggtacgactgctatccgtaatctttcgatttcaattgatcaaggtgagtttgtttatgtcgtcggaccttccggtgcagggaaatcgacctttatcaaattgatgtatcgtgaagaaaaagcaacgaagggtgttcttaatgtagcagggtatgacctgttgacgatcaagaatcgcgaagtgccattgatgcgccgcgaaatcggtgttgttttccaagattataaattgcttccgcgaaaaacggtttatgagaatgtcgcttatgcgatgcaagttattggccgcaagcctcgggaggtcaaaaaacgggtaatggaagtattggaccttgtaggattgaaacacaaagtacgagtcttcccaagtgagctttcaggcggagaacaacaacgggtttctattgcacgagcaatcgtgaataccccgaaagtattgattgcagatgaaccaacaggaaatttagatcctgagaattcttgggagatcatgaagttgttggatcggatcaatgcacaaggaacaacagtagtgatggcgacacacaatagcacgatcgtcaatacgattcgtcaccgtgtaatcgcaattgaaaatggtcggatcattcgcgaccaagcggaaggagaatatggttacgatgattagaacgtttttccgtcatctccttgagagtattaaaagtttaaaacgaaacggctggatgacgatcgcgtcactcagtgcagtcacgatcacgttgacgttagtcggtatctttttgggtgttattttaaatgcaacgaagttagccgaagacatccgtaagaatgtggatgtttctgtctttgtggatatcggaacagaacaaaaagacatggatactttggaacaatcgcttaaagaattaccgaatgtttcagacgttcgtttttcgagtcgtgatgatgaattgaaaaaaattcaggatgcgatgggggattcttggaacttattcgaaggggacagcaatccgctttataacgtatacgttgttagtgccacagatcctgaatacacgaaaaaaattgcaaaacaagctggagaattgccaaatgttttcaaagcagactatggtggcgattcttctgacaagatctttgctctatcagctgcggttcgtacttggggacttggggctgctatcctattgatctttgtggcaatgttcttgatttcaaatacgattcggatcacgatcttgtctcgtcaaagagagattcaaattatgcgtctggtaggtgctaaaaatggttacattcgctggcctttcttcttagaaggcggctggatcggattgctgggatcaattgtccctatcgctattatgtattttggttatcaccaagtttacttgttagtcaatccagcactgctacgttccaattatagtttgattgcaccaaatcagtttctactgcaagtttgtggtgtcatggctctgatcggaatcgtgattggttcattaggatcgatcatctcaatgcgccgtttcttaaaagcgtagaacgtgttattgaaacagatctgctgactagcaggtctgtttttcatttgccgacacctttactttagactgcaagttcgctattcttttaggagaggtgagggttggtatgttagttatggataacctgttcacgatcattttcttcgtgaacattttgttgtcgattgtgattatttttagagaaagacggcaaacggctcagacatgggcgtggttgcttgttttattgtttataccagtcgtgggatttgtactctattttttctttggtcgcggaatctccaaagaaaaaattttcgatttgaggacacaagccaaaattggtttgaacgtggagctggaagagcaaaagcaagcgctgcagcggaatctttatccccatccgcccactgcgcaagtagaagtcaaacagctcgtttatttattgacgatctatggtcagtcgttatataccactacaaatgaaatgactctttataaagatggtcgaaaaaaatttgatgcattactcaaagatattgaaggcgccacagatcatatccatatgcaatattatatttatcgcagtgatacattggggggagaagtacgagatgctttgatccgtgcagccaaacgaggagtgaaagtccgtgtgcttttggatgcttggggcagcacccaggtttcactgaaattcttcgatgaattacgggttcatggcggtcaagttgcgttctttttcccgttgttcgttccttatctcaatcctcggatcaattatcgcaatcatcggaaaattgtcgtgatcgacggcaagattggttataccggtggtttcaatgttggaaatgaatatttaggtgaggtggaaaaatttggttattggcgggataatcatctgcgaattttaggaccagctgtttactcactacaaaaccggtttttgatggactggaattcacaacatgctatcgaaatcaaatatgaagcagcgttgtttccaatgatcgaaacaaacggaacgattgctgcacaggtagtgactagcggtcctgattcagaacacgaagagataaagataacttatttgaagatgattaatttagccaaaaaagaaattttgattcaaactccctattatattcctgatgaatcgatccacaatgccttgaaactggcacttttgtccggtgtttctgttcatttgcagatccctaataaaccagatcatccacttgtctattgggcaacttactcttttgctgctgagttattagcctatggtgcagtggtagagacttatgagaaaggttttatgcacgccaaaacgatgattgttgacagtggggtcgtttcgattggttctgcgaatattgatgttcgttcgtttcgacttgactttgaggtcaatacagttgtctatgatgcaaaagttgctgaggaagtgcgccaagcattttttgctgactccaaggattcagaggaattgactttggaaaaataccggaatcgccgattgttgatcaaggtcaaagagggattagcacgacttgtttcgccgcttctatagaaactatttagtaaacgtaggtgaaagttgggtaacaaaaaaacagcagtaatgctgaagcacctcttctaacgtttgttttttggatcaacgttagaaggtgattcatgcaactgctgttttttattatttcatgatacttgtgtaggctgccagaaaaactgacccgactgtcaaaataagcattgtccaaataactacttgagtgattttggcgaaggtgctttttggttttttttcgttcatcgtgatccaccttttagattgatttctagtcacagtttacctccaattaccaaagaactcaagctgctattcttataaattaagaaatcttgaatattttgcaagagcacaaaaagttttttcaaagattctcttgttgaagggtggttgttctgttttaattagtaaagatatagagaaaaaataagtagaaaataagcaggatgcttgagtaaggaaagtaaaagattgcagactgtcttattggaccgcggatttttaaacgaactgaaacatagatgtaaagaaaataaagtatagttacactagctgttagaaaggatttgtttgtatgtctggatttgggcctgctgttttattttggtatatctttccattagtcgttttttttgcttgcagatttttagtttctgcgttgtctttgaaagaacggtttggactgaaggcacccgacttagctgtgccttttttggtgattgggattcatcagttatcaaagaatacttttgagcaatcgatcactccctattatttgatctctatcttattactggggattctcttagctgtctttcaagcgtattattacgaagaaatccagtatggcagatacatcaaaatgtactggcggagtatctttttgtttacattgattttccatgttgttttgatcattttaaatatcgtcacgtatttgtaatttgtgacagggagaacccttatcccatcgagatttttctgcttaaagtttttttaaaaactttttaagagaaagaaactcctgttttttcgtttggtaaaaattagtcaaagaacttcacttttaaatttcacgttaaatgtggtagaaagtgggggattgtggtagactgtgattatcaggtggagatcgggggttatttatcgatgtttatgggtgaatttcaacattcgatagatgcaaaaggccgactaatcgttccttcaaaactgcgagaaaaactcggagaaaaatttgttgtgacacgtggattagatggctgtttatttggctaccccttatctgaatgggaaaaactagaagaaaaactgaacgaaatgcccttggcgaagaaagatgctcggacattcgtacgtttcttttattccgctgccacggagtgcgagatcgacaaacaaggtcgtatcaatattccggcaaccttgcgtgaacacgcgtcacttataaaaagctgcgtgatcatcggcgtttccaaccggattgagatctgggatgaagcgcgttggcaagcatttaccactgaagcagaagaaaattttgatgaaattgctgaaacaatgattgattttggcttataggaagaggaaagcgcatggcagaatttcaacactacaccgtaatgttgaaggagacagtggacggtttagctattcgtccggatggaatctatgtcgattgtacattaggtggagcgggtcatagtgaatatttattgtcccaattatcagaagagggacacctctacgcatttgaccaagatcaaaaagcgatcgatcatgccaaagaacgcttagcgtcttatgtggctaaaggaatggtcacgtttataaaaagcaatttccgctatttaaaggaagctttgcagcaacagggtgtcgatcaagtaagtggtgtgttgtatgatttaggcgtttcttcgccgcaattagatgaagcggaacgtgggttcagttatcatcaggatgcaccattagatatgcggatggatcagtcggctgctttgactgcttatgaggtagtgaatcaatttgattatcaccaacttgtaaaaatttttttccgttatggagaagaaaaattttcaaaacaaattgctcgtgaaattgaacggacacgagcaaataaaccaatcgaaacgactggagaattagtcgagattatcaaaacagcgattcccgctccggcgcggcgcaaaggcggacacccggccaaacggatcttccaagccattcggattgctgtgaatgatgaattaggtgtcattgaagaatctttggaacaggccatcgatttattggaaaaaaatggacgaatcagtgttatcactttccattctttagaagatcgaatcgtcaagtctacgttcaaagcttacagcaccccaaaagatgtgccaccagggttgccgatcatccccgaagaatttcaaccagtactaaaattaattactcgaaaaccacttcttccctctgaagaagaagtatctgaaaacaatcgttcccgtagtgctaaactgcggatcgcggaaaaaatgaaggaaagcgaaggttagcaattatggcagaactaaaagttcatgattatgaatttgaagaaacgtctgaacaagagttttatgctcactctgaaccgacaattgaacagctgccaagcgaacctgagcgtcctgaggttatccgtgtaccagcatctcctgctcgccggttaaaaagtatctctaatttagaaaaactgattgcagcatttgtgatcattgccgttttgacattagcgatcctgacgatcaatattcggactacgatcagtcaagtcgaacatgatatttcactgatccaatcagacatcaatgaaaaaaatagtcaagcagaacaattagagcaagaaagaaacgaactttctaaaactgagcgtatcaaaaaggttgctgaggataatggattgtcgatcgatgatgacaatttaaggaaagtggattaaatgaagctaacagataaattcaagcaatacttgaaaaagaaaaaccaaactacaacgaacaatcgcaaaaaagtaggtattattctctttgctacgagtattggattgttctttttgtttgtcacgcgtttgagctacattgttatcgtaggtaatgtggcaggtacttcattggctgagaaaaccaagagcctttatcaaggaagcgaagttgtcaaagcaaaacgcgggacaatctatgatcgcaacgggatcgcaatcgcagaagatgcaacttcttattctgtttatgctattttgtcaaaatcctacgttagtgggaaaaagaatttatatgctgaagagaagaactttgataaattagccaaaattctgaatgagcaactaggtattgatcagaatgaggctgtgcaaactttggaaaaaggtctaaaagaagaacgttggcaagtggaattcggtagccaaggaagtaaaatgacgctggagaaaaagacagcgatcgaagaagcaatgaaaaaagaaggaatcgctggcctttattttacagatcatccttctagaatgtatcctaatggaattttctcttctcactttatcggctatgctctagcagaaaatgaggagaacgactcttctggcttagtaggaaaaactggtttagaagctgcttatgatgatgtattatccggaacagacgggaaaatcgtctatcaaaaggataacaatcaaaacccgctaccgggaacggtggcagaatcagtggcagcggtagatggcaaagatatctatacaacgattgatagccggattcaaagctatttagaaacgctcatggataaagtgttcaaagaatacaagccagaagatctgactgccacattaatgaatgcaaaaacaggagaaatcgaggcgatggcacaaaggccaacctatgatcctgatgatttaagtaccatcaaaacctggcagaatttattggtcgaagacaactatgaaccaggatcgaccatgaaagtcttaaccacagctgctgctatcgatcaagggatattcgatgaaaatgaaacttttacaccaagtccggacggattgaaactgtatgatgcgacaatcaatgactgggactttggtcaaaaaggaacattgacgatgcgtcaagctctttcttggtcaagtaatattgggatggttactttggaacaacgaatgacagaccgttggcaacaatacttgcaacagtttggatttggtcgcagtacgtactcgggtctgccaaatgagaatactgggatcatgccggaaaataatccggtcagtcaagcaatgacttcatttggtcaagcaatcggtgtgacgaattttcaaatgatgcaggcttttaccgcagtcgcaaataacggcacgatggtcaagccgcaatacatcagcaaaatcgtggacaatgaaacaggtgaagagactgtaacacagccagaagttgttggacaccctatcacggaacaagcagcgacgaaagttcgagaatatatgcgtgatgtggtagaaagtgaaaactacggaagtgcgtatggtgtctatagtgtacctggttacaatatttcagcaaaaactgggactgcccaagtagctgatccaaaaactgggaaatacttatctggggattccaattacttgtactcaatcgtagaaatggttccttcagaagaccctgaatacattctttatctaacaattaaattaccagaacaccacgacagcgaagcattggcaaaaatcgccaatccgttgatgaaacgcgtgatggatttaaagaaagcaacattagaagaaacagcaacagaaaatagtcagaaagtaaccgtcaatgattatcgtaaattagatacaactaccgcggcaactgatgtacaaaaaattggtctagcacctgtagtattaggggatggaaaaacagttatcgatcagtctgtggacagtggatcgaaagtactgccaggagaaagacttcttttgctaacggatagtgacaaaatttatatgcctgacaccaccacatggtcaaaagctgatttagtcaaattgggcaacatgttggatgttgatgtcaaatttgagggcgacgggtattgtgtttcccaaagtcttgcatcttatgaggaaatcacggatcaaacaattaccttcaaattgagcgaaaaagaatagggagagaacactatggaatggacagagatgatattgccacttgccagtagttttgcaatcgttactgctgcaatgccgctgtttatcggctattttcaaatgaaaaaatacggacaagagattcgaggagaagggccaaaatggcacaatgtcaaagctggcactcctacaatgggcggcttcgtatttttgattgcggcattgatcacagcagtttgggttggcgcatggcaaaagcagttgaccgcatcgctgttcattttgttatttattatcttggtttatggtgcgcttggattcttggacgatttcatcaaaattttcaagaaacgcaacatgggtttaaactctttacaaaaattgatcggacaaatcatcggtgggattgtcttttatctggtctttttatcagaaggcaatgcgaatgttttgaatctctttggatttgagctgccgctatcgatcttttacggcgcatttgtgattttttggttagttggcttttcaaacgccgtcaacttaacagatgggattgacggcttggttgctggactcggtacgatctcatttgcaacttatggcctcattgcttggcgtcaagatcaaatcgatatcctgatcgtctgcttagcggtcattggaggattgatcggcttcttcccttacaatcgtaaaccagctaaaattttcatgggtgatgtgggctcccttgcattgggcggtcttttagcagcagtttcaatactgcttcaccaagaatggacattattacttgtcggacttgtctatgtgattgagacagcaagtgtcatgctgcaagtcgcttctttcaaattgactggtaaacgaatttttaaaatgtcgcctattcatcaccattttgaaatgagtggctggtcggaatggaagatcgatacaattttttggctgattgctttaggatgttcgatcatcacattagtgattgtatggtaggagagaggaatcatatgaaaaatataaatgaatatcaaaataaaaaagttcttgtgctaggattagcaaaaagtgggttcagtgcggctaaattgttacatgatttgggcgcgcttgttactgttaatgacggaaaaccctttgccgaaaatccagaagcacaggatcttttggcgttaggcgttaaagtaatcaccggcagtcacccaattgaactactggatgagggtttttcacttgtggtcaaaaatcctgggattccttatgatcagcctattgtccaaaaagcgatcgagaaaaatatcccaatcattacggaagtagagttagcttacaaaatttcggaagcaccgatcattgggatcactggaacgaatggaaagaccacgaccactacgatgatcgctaatgttttaaatacgggatttagtgaaggccgggcattgttgtctggaaatattggctttccagcaagtaacgtcgcccaaaccgctagcgctaaagatcgcttgatcatggaactttccagcttccaattgatggggatcgaaacattacatcccaagattgcagtcatcacgaatatttatgaagctcatctagattatcatggcaatcgatccgaatacgtgcgggctaaatggcggctgcagcaaaatatgacagcagaagattttctagtcatcaattggaaccagccagaattagtcgaactttctcaacaaacaaaagcaaaagtgattccattctcgacacaacaaaaagtggccggtgcgtatctttttgaagagcagttatatttcaaagatgaggcaatcatgcctgtttctgaactgggcgttcccggcagtcacaatgttgaaaatgcattagctgcaatcgcagtggcaaaattagaagggatagcaaatgaggctatcgttcaagcattgcatacatttagcggtgtacctcaccgtactcagtatgttgatacgattgaaggggttcgctttttcaatgattcgaaagccacaaatagcttggcgacagagatggctttaggtggtttccaaaaggatcagttgattttgttggctggaggattggatcgcggcaactcctttgatgagctgattccatcactgcaagatctcaaagcgattgttttgttcggacaaacaaaagagaaacttgctgaagccgcacgtaaagcaggaatcaaaacgattaaattgacagaagatgtaactacagctgttcctttggcttatcaattaagccaaccgggagataccgttttattatcaccggccaatgcaagctgggaccaatacccgaactttgaagtacggggggataaatttatggcggcagtagcagaacttaacagaaatgagcgaagtgaatgaaaatactagtaactggcggtggaaccggcgggcatatttatccggcattgtcttttgtcgattatgttcgttccattgatccaacagctgaatttttatatattggggctacccgtggattagagaacaaaatcgttccaccaaccgggattccttttaagacgttagaaatacaaggctttaaacgaaaactttcattggacaatgtcaaaacagtccaacttttcctgaaaagttatcgtgaagcaaagaaaatactcagagaatttcaaccggatgtagtgatcgggacagggggctatgtctctggtgctgtggtctacgcggcatcagtacttaagatcccaacgatcatccatgaacaaaatagtgttcctggaatcactaataaatttttgaccagatatgtggacaagattgctattgcttttcaggatgcagcacactattttccggataagaagacggtcttggtggggaatccccgcgggcaagaagtaaaaaacagtcagaagtctgcgatccttgcttcctatgaccttgaccctaagaaaaaaactgttttagtctttggcggcagtcaaggagcactgaaaatcaatcaagcgattatcgaagcaattccgctttttgcaaagaaagattatcaactgttatatgcttctggtgaccgttattaccaagaaatcgaagagaagatcggtatgtcgaaagatgcctttccaaatatcagcattcgcccctacatcgatcaaatggcagaagtcatggcgaatagtgacttgttgatcggacgagctggcgctacatcgatcgctgaatttactgcattgggattaccagcgattttgattcctagtccttatgtgacgaatgatcatcaaacaaaaaatgcgcaaagcttagtcaatgctggggcagtcaagatgattgcggacaatgagttgaacagtcaaaatctaattgagtgtgtcgatgcgatcatgagtgatgaaaacgtacggatggaaatggcaaaggcgtcgaaagagcaaggaatcggtgatgcatctgagcgactatttcgacttgtgcaagaggtaatcaaatagtacaatgtgttggatagaaaggagagattgtcatcagtaaagataagaaatctcatgataatcaaaccacccccacgacagaagaattgaccccttggcagaaagaaaatctgcgttatcaaaaagaaaaaggcgatcaacctgtatggtcaccctctgtcatttccgggattcactcagatgaagaacaatcagaagaccaaacagaagaaaagcacgaagaaggcgcagagactgaagattcagaacaagctccccgctcttttgctgatcgattgcccaatttaaaaaaataccgtaatcgagtattgttgcgccgattgctgttgattattggtgttttgctgatcccgttgttatttattctgtattacgtctccccgttgagtaagttagcggatgttaaagtcgtgggcaatgatcaagtgtccgcccaatcaattattgaacattcggaattaacgactggagaagaaatatggccgcagtattttgacagcgaacaaacggaacaagccatcaaaaaagcgttgcctcgtgtcaaaaatgttcaagtgacaatcacttctttaaaccagttcaagattcgggtatcggagtaccaagaggtggcattgctagcaagcgataatcattattcacctattcttgaaagtggtgtcgtggtcaatgaaccgagtgaccagcctctggaaggactacctattttagagagcttttcagatcagtcaaaaatcaaagaagtactgactgcttatcagaagctcagtcaagagattcgtgaaggaatttctcaaatcaagtacacgcctcgggacagtaatgacgagttgttaacgatctatatgaatgatggtaaccaagtgattgtgaacatttcaaatatggctagtcaaatgcagtattatccgcaaatcgcaaaagatttgaaagaagacagtatcatcgatatggaagtgggcatctttacctatccgatttccaatacaaaagacagtgactcggcaacagaacaatcgaccgaaggggattcttaggaaaaattcaagagtttttttcattaacttgtttctaaaaatcgctattatatggtagaattggtaacagtgaacaaattattctaattagatataaatacgaacttttcaaggttcgcgatatatgcaaattaagtaggagggaaccccatccatggcaaaaacgggaatgtatgttggcctcgatattggtacgacatctgtgaaagttgttgtagctgaatacgttgatagccaaatgaacattattggtgtaggaaatgcaaaatcagaaggaatcaaccgcggaatcattgtagacattgacaagacggttcaagccatccaaagagcagtaagacaagcagaagaaaaagcgggtatccaaattcgcagtgtgagcgtgggtgtgccagccaatctgttagaagttgaaaattgccaagggatgattgctgtcaacagcgaatcaaaagaaatcacagatgacgacgtgcgtaacgtagcatcagcagcgctcgttcgatctacacctcctgaaagacagatcattgccattttaccgcaagagtttactgtggatggctttgaagggatcaaagatcctcgcggaatgatcggtgtccgcttggagatgtttggggtagtttatacaggccctaaaacgattttgcacaatattcgcaaatgtgttgaaaagtccggcttgattgttaacgaacttgtaatcacaccactagctttgactgaatcgattttatcagatggcgaaaaagattttggtacgatcgtgattgatattggtggcggtcaaacaacaacttcggtaatgcatgacaaacagttgaaattcacccatgtcaatcaagaaggtggagaatttgtaacaaaagacatctctactgtgttgaatacttctttcaataatgcagaagcgctaaaaatcaattatggtgatgcttatcctgaacgtacatcggcaagcgaagaattcccagtggacgtcattggtaaatctgaacctgtcaaaatcgatgaacggtatcttgctgaaatcatcgaagcacggatggagcaaatctttaataaatcaaaagatgtcttgaatgaaatcgatgcgtttgaattaccaggcggaattattttgactggcggagctgctagcttacctggcgttgtcgatttagcacaggaagtcttcgaaacaaatgtgaaattatacgtgccaaaccatatgggattgagaaatccggttttcactaatgtgatcagtatcgttgattattctgctaatttaagtgaagtttatcagcttgctaaaagcgcgatcacgggtgaacgtacgacgcaacaacctgttgctgttcaacaagagatttcttatgagcagtatgaggctccagaagaaacttatgaagaaccagaagaagagaagaaaggcgaatcgatcacgaatcgtgtaaaagatttcttctcaaatatctttgaataatctaaaacgatactcaggaggaagataaactatggaattttcaattgataacaatatcaatgatggcgctgtaatcaaagttatcggtgtcggcggcggcggcggcaatgctgtcaaccgtatgatcgaagaaaacgttaaaggtgtcgaatttatcgctgccaatacagatgtgcaagcattgaaaaattcaaaagctgaaacagtgatccaattaggccctaaatatactcgcggtctaggtgctggctctcaacctgaagttggagaaaaagcagcagaagaaagtgaagacgcaattcgtgattccttgcaaggcgctgatatgatctttatcactgccggcatgggtggaggtaccggaactggggcagctccgatcgttgcaaaacttgccaaagaaatcggtgcattgacagtcggcgtagtaactcgtccattcacatttgaaggaccaaaacgcggccgtttcgcagctgaaggaattgcaaaactaaaagaaaacgtcgatacattattgatcatctccaacaaccgtttattggaagttgttgacaagaagacaccaatgctggaagcattccgtgaagcagacaatgtattgcgtcaaggggtacaaggaatctctgatctgattactgcaccaggctatgtcaacttggactttgctgacgtgaaaacagtaatggaaaatcaaggaacagcattgatgggtattggtgttgctagcggcgaagaacgtgtcatcgaagcaacgaaaaaggcgatctcttctccattgctagaaacatctatcgatggtgcagaacaagtcttactgaacatcactggcggattagacatgactttatttgaagcacaagatgcttctgatatcgtagcaagtgctgcaacaggcgacgtaaacattattctaggaacttcaatcaatgaagacttaggagatgaaatccgtgtgactgtgattgcaacaggtatcgatccttcaaaaaaggaacgctcttctcgtacaagcagacaaagtcaaatccattcaattccacaaaaaccaacgttagatatggatcaggcgaaaccttcacacgtagaagatgatcatggctttggtgattgggatattcgtaaagaacaaaacgttcgtcctaaagtagaagaaagccaatttgagaatgttgaaaaaaaagaatttgatacattcaatagagatgaagtaaaaacaaatgacgacgatgaattaagtacaccaccattcttccgtcgcaaacgctaggaggcagagcacatgatttctgagaacttgcacaagatccagcaagagatccaggattcttgtgctcttgtttctagaaaagcaagtgaggttcgtctggttgctgtgacaaaatctgtcgatagtgaaaaaacacggaagatcatcgaagccggtgtcactgactgtgcggaaaaccgagtagaaaaactcctggaaaaaaagcagcaactagcagactttccagaagtaaactggcattttattggtaatttgcaacgcagaaaggtaaaatcaattataaatgaagttgattatttccatgcgttagaatcgctgaaattggcgcaagaaattcaaaaacgagcagcaaaaacgattgcttgttttgtagaagtcaatatttcaggtgaagcaagtaaacaaggaattgcaccagacgacgttgtttcatttattgaagagttgcagccctttgataaaatcaatgtcatcggcttgatgaccatggcaccacttgcttcttcagaagcagagcagctcaattattttcatcagttgaaagaattacaagaaaaaatcgcagcgctgcacttggcacatgctccatgtacagaaacaagtatgggaatgagtaatgattttgccgttgcgatccaagcgggtgcgacagttgttcgcatcggcaccgcattatttcaggagtaaaggaggttgacatatgtctttaaaagagaaattgaccaatttttttggattgacagatgaagaagattattacgaagaaagcgtggtagctcaagaatctgtgcgatccccgcaaaatatcgccgtcaatcaaggtagttcttatgttgcaccacgcacgactcgtgctgaaaatccaacgaatacattttcacgaagccatatgccatcacagcaagcgcaagcgcagcgttcaacagcatcaagtgcgtcctttgaaagacaacaacgccctgtccagaagacagaggaaaaggtcgtttctatggcccaacaacgcagtaatcccaaaacaaaagaaataaagtccaaggctgcaggcaagattactatcgtagaaccaagagtttattcagaagcgatgggaatcgcgaaacaagtgatcaatggcgatgcagtacttgttaattttcatttaattgaggagtaccaagcacggcgaatagttgattttttgacgggaacagtgtacgctgaagatggcgatatcaagcgtgttggagatgaaatcttcttatgtacgccaaaaggaatggagatcgagggaactgctcaaacattagcagatagtaatttcttcgatatctgagtcaaggaggaaagcatattttagtctttaggttattaaatctattcagtgatgcagtatatctctatacagtattattagtgatctatgccttgctttcttggtttccgggaggataccaatcagcatttggacgtttcttagcaaaaatctgtgaaccatatctaggtttgtttgatcgtctaaatctgagtttcgctggcatcgactttacgattgcatttgccattatcgttctgcagctagcaacgcaaggtctgttcgttcttctacaagcaatcttattctaacgtaaggggtgaatatcgatgaacgcaaatgtctatcagcattttcgaagcgatgagcacccttttattgattctgcgcaaggctggatcgaacaagtgcagatgcaatacgcaccctatttaacagattttcttgatccgcggcaagcctatattttagaaagtctgattcggcaatcaaccgatttgagttttcaattttttggcggatatgaagctgctgaaagaagacggtgcctgatctacccagactattaccaaccagcaagtgaagaatttgatttggtattattcaccattatctatccaaaaaaattcacggttttaagtcatgggaaggttttaggaacgttaatgggcacaggggtcaaaagggaatactttggtgacatcatttctgatggggaaaattggcaagtatttgtggcaagcgaaatcagtcattttgtccaaacacaggtcgataaaatcgggaatgtctcagttcgcctcgaagaaacgaagtacacggaattgatcgtaccaaaagacggctggagcgaagaacgagaaacggtcagctctctccgtttggatactgtcatttctgctgtctataatatttcgcgccagcgttccaaacaactcatcgagtctggcaaagtgaaagtcaattggacagaaacattacgtccggattttatgttggatctactggatatcgtatcaatcagaggatttgggcgtatccagattcaggggttagaaggcacgacaaaaaaagaaaaagttagattgttattaggtgtattacgtaaataaaacaaagaggtgtaaacttatggcattaactccattagatattcaaaacaaaagcttttcagtaaaaatgcgcggttacaatcaggatgaagtcgatgacttcttagatatgatcgttcgtgattatgaagaagctgttcaaaagaaccgtgaactagaaaaatcattgaagcatgcagaagaaaaacttgagtatttcaatgaattgaaagatgcattgaaccaatcgatcatcgtggctcaagataccgcagacaaagtaaaaacgagcgcaagcaaagaatctgaagtgatcgttacttctgctcaaaaccgtgcagatgaattagtaacgaatgccgaaaaacgcgctcatgcattgacaacagctgcagaagaaaaagccaaagaaattctgacggatgcaaccaataatgcgcgtcaattggcaactgaaaccaatgatttgaagaagaaaacgcgtgttttccacaacaatcttttggttatgctgcaaacacaattagagcaagtaaaaagtccagaatgggaagaaattttggcgccattttctagctatgtaaaagattctcatcaagtaatcaaagaagttttatcaaaagaacttgacagcgaaaatgattctgaagtaaactcagaagcagtggagagtccagtagaaatcgtggaatccagtgagaaagaaattgatgtagaagaaaatccagaagtgaaaacattggatgatgcacgtcaattactagatgaattaaataaaacaaatgactaatatacagaacagaaaaatttcttatacttttaaagcgagtctgggagagtggaagccggataaaaccctgtaagaaattagatcatctgttagtcttggtcttgaacagtggtagagtccaacgtttgatctcgttaccgatcaacaaagaattgtcactgacaataaaatttgggtggtaccacgaacacgttcgtccctttccgggatggatgtgtttttttttatagcttcatagcctatgggcttattagaaggatttggtcgattcaatgagtgaattcactgaaattgaggcaggatagacaaaattgtttgatcgacatgtgcttgcacatgccataatcatgagtaatcagtaaaaggagcgaatacaatgaagatgaaagaaacattgcatctgggaaaaacggcttttccgatgcggggaaatttgcctaatcgcgaaatcgaatggcaaaaagattgggaagaacaaaatatctatcaacaaagacaagcactgaacgaagggaaaccaacatttgtcttacatgatggccctccctatgcgaatggcaatatccacattggtcatgcattaaacaaaattagtaaagacattattgtacgttctaaatcaatgtcaggattccgctcaccttatgtaccaggttgggatacgcatggattgccgatcgaacaagtgctgacaaacaagggcatgaaacgcaaagaaatgacacttgcggaatatcgcaaaaaatgcgaagagtatgctttgacacaagtagatacccaacgtgaggactttaaacgtttaggaatctcaggtgattgggatcatccttacatcactttgacacctgattacgaagctgctgaaatccgcgtattcggaaagatggcagaaaaaggctacatctataaaggattaaagccaatctactggtcaccatccagcgagtcttcattggcagaagcagagatcgaatacaaagatgtcaaatcaccttcgatctatgtcgcttttcctgtagcagatggaaaaggaatccttgatgaagatacatctttcgttatttggacgacgacaccttggacattaccagcaaacttaggaatttcagtaaacccaacgtttacttatgttcaaatcatggcagatggccgtaaatttgtaatcgccaaagatttgttggagactgttcaagcagctattggatgggaaagtgttgaaatcttgcaagaaattgctggagaaaaactagaatacatgactggccagcatcctttctatgatcggacttcattggtgatgctaggtgaccatgtcacgctggaagcaggtactggattggttcatactgctcctgggcacggggaagacgactacatcgtaagcaaaaaatacaaattagatgtcctatctcctgtcgatagtcgtgggatgtttacggaagaagcaccaggatttgaaggaatcttctatgataaagcgaacccaatgatcaccgatttgttagcagaaaaaggtgcattattgaaacttgatttctttgtccatagttatcctcatgattggcggaccaaaaaacctgttatctatcgggcaacaccacaatggtttgcttcaatcgatcaattccgtcaaaacatccttgatgaaatcgagaaagtggactggatcattccttggggcaaaacacgcttgtacaacatgattcgtgatcgaggcgattgggtcatctcacgtcaacgtgcctggggggtaccactgccgattttctacgccgaaaacggcgaagcaatcattacgccagaaacgatcgaacatgttgcaacgctatttgaacaacacggatcaaatatctggtttgaaaaagaagccgaagaattattgcctgcaggctttacgcatccgggttcaccaaatggcaaattctctaaagaaacagatatcatggatgtttggtttgattctggttcttctcatgaagcagtcttgcgtcaacgtccagagttgactttcccagctgacatgtatttggaaggttcagatcaataccgtggatggtttaactcaagtatcaccacaagtgtggcgatcaatggggaagcaccttacaaatcagtcttgtctcaagggtttaccttggatggtgaaggccggaagatgagtaaatctcttggaaataccattgctccagagaaagtaatcaaacaaatgggtgccgatatccttcgcctttgggttagcagtgtagattatgaagcagatgtccgagtttcaatggatattttgaatcaagtctccgaggtttaccgtaagatccgtaatacaatgcgtttcttattagccaatacggctgatttcgatccaaaaacggatatggtttcttatgaaaacttacgctctgtagacaaatacatgctggttcgattaaacgaaacgatcaaaaccattcgtgaagatgggtatgagaaatacaatttcttgcatatctataagacgatcatcaatttcttgactggcgatctttctgctttctatttagactttgcgaaagatgttgtttatatcgaagcggaaaatgatccacaacggcgagcaatgcaaactgtcttttaccaaacggcagtggctttgacaaaattgttgacgccaatcattcctcacacagccgaagaaatctggtctcacttaaaagaagaggaagcctatgttcaactagctgaattgccaagttatgaatcatttgcgaatcaagctgagttgcttgatatgtggacggcatttctttcattccgtgacaatgtcctgaaagcactagaagaagcacggaatgaaaaactgattggtaagtcattggaagcaaaagtgaccatctatccatcacaaccgctggcagacctattaacggctgttgatgctgatttggcccaattattgatcatttcaccagacttcttcgaaatcaaagaggcaggaagtgccgctccagaagcagcgttacaatttgaagatggtgcaatcttgatcgaaaaagccgatggtgaagtttgcgaccgttgtcggcaagtgcggacagatgtcggagtggatgagaaactgccaacactttgcgggcgttgtgctcatttggtggaagaatattatccagaagccgttgctgaaggctttgagaaataaaaattagctgagaaataaaggtaagccaaaaattatcagtgtgccgttggacgatctacttagatcgtccgatggcacacgttttttgtgatcatttcattgtgctgacttagttatcagcttttgtgtctttttcattgttttctcctagcaatagcaactagacgacagcaactgatgataagaagcatagaagtgacaaaaatgcagcgctaggcaatcgtgcttgctttgtcccaatcggttttacccgttcagcgtttttgagagaaagctagaccaacttgcagaaaaagattgcaagatttacatagaaaaggtaaactgttaaaaattggaatattcagaatatttaaagaaaggatgaggggatgagggaaaaagagacattaatgtatgatcctcgttttgaaagtgatgcttgtggcatgggctttatcgtacaaaaagatggattatactcgagaaaactgattgaaaatgcgttgacgatgttagaacgaatgaatcatcgtggcggaacaggagccgaaccagatacaggggatggtgctggtgtgttgatggcattacctgatcctttttttcaagcaattgctttagcggcagagattgttttaccgccgaaaggtcactatgcagtaggcatgttttttttgccgcaagaacgagaatccgcagtcaaattaagaaaggccgttgctcaggatattcagcaaatgggatttcgggtgttgtggcagcgggaagttccctatgactattcgcaatgtggtccaggagcacaaaaagtgatgcctagtttttgtcaattctttattgaaaaacctctcgatgtgacagtcggaagagattttgaggaccgtttgtatcatttgcggcgacaattagaaaaaaactatgcagcccaggaactagccatctgcagtctttctagccaaacaatcgtctataaaggcatgttacatgcttatcaggtcggactgttttattcggacttacaagatccgcgtatgacttccagtatcgcattgactcattctcgtttttcaaccaatacttttcctagctggaatcgcgcgcagccttttcgttttttagcccataatggggaaatcaatacgttaagaggagccgaaaattggatgcatagtcatcaaatcgaagtctatgatgaggaaaattcggactccgcaaaacttgagaattgcatggaattcttgtatcgccaagggagagatttacctcaggcgcttttgatgatggtacctgaagcctggtcgaaagaagccggtttgccagaagaactagttgcttttcatgagtacaatgctagttttatggcaccatgggatggaccggcagcgctttgttttacggatggtgagctggtgggtgctgctttggatcgcaatgggttgcggccttcccgctattcaattacgagggatggcttagttgtcgtagcatccgaatcaggggtggttgatctacccgcagcagaggtaattgaaaaaggggttttaggtccagccaatatgtttttggtcgataccaaaaatggcttgattttgagaaataaagagatcaaagaaaaatatgcgcaagctcatccttatcgcgaatggttgacagaaaatttgttaacgatggatgacttaccagaaccccctttttctgatggattatcgacagagacactacagcggttatggaaacttcacgggtacaccgacgaagtcatccggacactgctgatccctatggctcagacaggagaggaaccggttatctccatgggatttgattcaccattagcaatcttaagtgaacgtccccagtcgctttttacgtactttaagcaactattcgcacaggtaacgaatccaccaattgacgcgattcgcgaaaagctagtgatcggtacagaattatttctgggacgagatggcgatgttacaaaagatcttagccaaaattgccataaattaaaaatcgctagtccgattttaaccacaagcgagtatctgaagatcaaacatctaagtcagaaacaacaatcggcggcagtcctctctactctttattttgtgactggcaatgagcagcaaacactgcaccatgcattggatactctttttaaagaaagtgaagccaaaattgatcaaggggctacgattctcgtgttaagtgatcgcgaacccattgcaccacaactaggtaagatggcaattcctgtcttgttggctgtttcgggtttgcataattacttggtgcgaaaaggaaagcgagcgcttgcctcactcattgttgacacggctgaagtctgcgaagttcatcactatgctatgttagttggctacggtgccagtgggattcatccttacggggcttacgaaacgctgcattattatgacatgagtgatcatgtcgaaaattatcgacaggcctgtgagaagggactcataaagattatgtctcgtatgggaatttcaactattgccggttatcatggtgctcagctctttgaagctgtcggtatctcaccacaagtcactgaggtttattttacgggaactgtttctcggattggcggcctgtcgttgaaacaaatcgaacaagagtattttgagcgatacgaagctgcctatggtgaaaaacaacaggattatctagattcgggaggcagctttcagtttaaagcagaaggtgagcatcacctttttaatcccaaaaccatctatcactttcaaaaagcggtgcgcacaggagattatcagttgtacaaggagtatgcagctgtcatgaatcaagaggctttaagcacacccacgacacttcgttcactatgggagttcacaccttcgcgtcagccaattccattggaggaagtagagcctgctgtccaaatcgtcaaacgattcaaagtaggagcaatgtcttatggatcgctaagtgaggaagctcataaatgtattgctgaggcaatgaatgccatcggagctaaatcaaatagtggagaaggcggggaacatcgcgagcgtttcaaagcggtcaacggcaaaaattacaatagtcggatcaagcaagttgcttctggacgttttggagttaatgcggagtatttaatgagtgccgatgagttgcagatcaagatggctcaaggagcgaagccaggtgaaggcggtcaactgcctggaaataaagttttcccttgggtcgctgagattcgcggatcaacccctggggttcgcttgatttcaccaccccctcatcacgatatttattcgattgaagatttggcacaattgatccatgatttaaagaccatcaacccttatgcgcgaatcaatgtgaagctggttgccagtacgggtgttggaacgattgcaaccggtgttgtcaaggcaggtgctgatgttgttgtaatatcaggctatgatggcggtaccggtgcttctccccgcaattccatcagagatgcgggcttgccttgggaaatggggttagcagaagctcatcaaacattggcactcaatcatcttcgtcagcggatgaccttagaaacggatggtaaattgatgacgggaagggatattgcgattgcggcacttttaggtgctgaagagtacagttttgcttcattggcccttgttgcgatcggctgtgtgatgatgagagtctgcagtctgaatacttgtcccgtgggtattgccacccaaaatccagctttacgaaagttttttgctggtaaaccggaacatattattcatactatgtttttcttagcagaagacctcagagaaatcatggcagaactgggttttcgtaccattgatgagatggtggggcacacagaagtcttggtacctcgtttcattgccaaagggaaagcaaaatcattggatttcgctcgcatcttgggtacgacacttccgattgcacgtaaagtgacggatccttttttggagaaacgacaatggccagaattggatagttttgccaaagcagcaattgaaaaacaacatcctgttgctatcagtcaaccgatcaacaatattcaacgttctgttggtgcccgcatagggggatggattgcagaacgctttgggaactatgaacttcctccaggattgctgcaattcaattatcaaggaattgcgggtcaaagttttggtgcctttgcaacgcaaggacttgagctgagattggttggagaagccaatgattacgtagccaaaggattgagtggtggccgtttgatcattgtaccgccagcagatgctagttatgatattgaacagtcgcccattgtaggtaatgtggcttgctttggggcaaatcgaggagaaggatatttcagaggtctggcaggagaacgtttctgtgttcgaaatagcggagccaaagtggttgtagaaggaatcggcgatcatggctgcgagtatatgactggaggtgtcgctgttattctaggcaagacgggccgcaattttgctgctggcatgtctggaggtgtcgcctatgtgtatgatccggagcaagcgtttgctgctcaatgcaatttagaaatggtggaattgtttaaggtagatgagagcggggatgatgcggtattgaaagaattgatcgagaaccattttgcctatacagattccttaaaagcagccgagattctaagcgattggctctatcataagcagttgttcatcaaagtttatcctaaggaatatcatcaaatggtggaagcgactcatcaattggcgcgacaaggtctctcaggagatgaactgatcgctaaagcttttgagtcagttgtcggtcctcagatgacgatcccaggaaaggagcatgactagtatggcagatccttttggtttcttaaaataccctcgaaaagaaaatccgtatcgtccggtagcagagcggatcactgattggcaagaactgcaagaaccattgccggcaagtgagcggcaagaacaagcagcaagatgtatgaattgtggcattcctttttgtcataccggttctttctatggcgggcaacggacagtttctggatgccccaacgataatttgattcctgaatggaatgatcttgtttatcaaggcaggtttcaagcggcttttgaacggttagcgaaaacgaatccattacctgaaatgaccggacgggtttgtccagctccttgtgagaaaggctgcacggaggcactaaatgggagcggggtcacgattcatgacaatgagcgtttcattatcgacactgcatttgagaatgattgggtccgagcatcgggagaaccgcaagcagcaactggtttcaaaatcgccatcattggcagtggaccagctggtctatccgctgcttggcgcttgaatcagttaggtcatcaagtgacggtttatgaacgcagtgatcgttgcggggggttgctgatgtatggcatccctaatatgaaactagataaaacagtggttcagcgcagaatcgatttgatggcagaactaggcgtgacgttcctaacgaatgtcgaagtcggccgcgacatttctgctgaagaattagaagctgcttatgatcgtgttattatttctactggcgccagtgttccgcgggatttaaagatcccaggaaggtctttgacagggattcagtttgctgttgattatttgacagcagcaaccaaagaggtattgaaccatggaaaagctgcgaatgaatccttggcaggcaaacacgtggtcgtgatcggcggcggagataccggaaatgattgcttagggactgcgatgcgccatggggctgcttctgttcgtcagttggaaatcacgccacagcttccaccacagcgtttagctgaaaatccatggcctgaatacccaatgacagctaaaatcgggtatggtcaggaagaagttgctgcggttctacaggaacatacgtatcacagcatttcgacaactgcttttgtaggagcggaacggggacaggtgattgggatcgaaacagtcaaagtagatgagaattttcagccaatctctggtacagagcaagtgatgaaagccgatttagttttgttggcaatgggcttcttaggtccagaaacacacttgttagacaccttcaatgtccgtgaaatctatgatgattatacaaccaataatgaacgggttttagtagctggtgatgcaaaaagaggtcctagcttagtgatttgggcaattcgagaggggcggctcgctgcggagaaagtcgatcaatcgctgagggccttgatttatcaacaaatttagcaaaaacaacgggaaaaatgcgacagataagacaaataaaccgaaggctatctctgaaaagcgatgcgcaatcttgcgcgaaggacgaatcgtccaagaagcttagcaggtatccttcggttttgttgaatctttcgtcacatagcagatactttgtactgtgcccgcggtccgccgatatatttggggcgtgagcctaatgcagtcacatgagctgcacctaacgttttgatacttggccgaatagggatctgtacgtgtttgacatgcatgccgatggcagtatcaccaatatcgatgccagctttcgcaacgatatgctccacttcaacgggatcaacaaacaagcgaaatgccgctacagaacaagcacctcccgcatgaagtgcagggacaactgccacttcttctaattgataatactgagcagtgctacgctctacagctaatgcacggttcaagtgttcgcatccttgaaccgctaagcgaatgccaagcggatccaacacctctttaatggtcttaataatgatgtagcctacttcttcgctggagtttttgccgatcatcccgccaacgacttcgctagtagaacagcctaaaacaaataaatcattttgcgttaagtgtgctgcgtcaattacttcagttgtgatggttactaagtcatttttaagttgatgaaaatcattcattggaatcttacctctcattcaaagaaaatttttgtgttcgttttaaataattgacaagcggaaatgctaccaatataccaaaaacattttgaacgctattgctgagaatcgaagcaatgcctgctccaaagccaaacatgatggtcgttgctgcggcatagcctaaaatcatcgtcacgcttcccaaacaaagtgccagcaggggatagtgacgaaaacgaccagtaatgtagccttggcagccatggatcaaaatagaaaacaatgcccattctggataaccggacaaaaagtcgatcattccgccgctcaagctgccgacgatcgcacctgaaggaccgcctaataaaagagccgtggtatagatgccggcttcgcaaagggtcacgacaccttttgtctgaggaactggcaggacaaataataaagaaagagcggtagtcagtgctgtcagcatagctaaccttgttagtttcttggtagacatgaggtaactcctttcctaaaataagcaagttgatcgacatttcctaaagattctgtcagctgtagcccattttcaatgccggcaaaaacaaagtctttggcttgctgtacagcatctgtcattgagcggtcagtagccaagagcgcagcgatggcagcggataacgtacaaccggcgccgttcgttgtctgtttgggtgattttggtgtctcaaaaaagaaaaagtcatccccatcatagagcaggtcgcaggcttgctgcccgttcagacgagcgccacctttgatcaacacaaaagcaggcccaagtgctttgatttttttggcagctatcttcatttcttcccgagtagtaatggcttgatttgcgaaatattctgcttcaaccaaattgggagtaacgatagtggctaaagaaaataaggattgcagggcgtgttgatactcttgattggcttttgtctgtccttctttaaaagctaagactggatctaagatgatcgggcagtcttgggtcactaggaaatttttcactaattcgatcgtttccagtgtatgtaataggccgattttgatggctgctaaacgggtgaaagctgtaactgaagctaattggtccttcagcgttgcaggagggatatcataaatggtgatttcctcattgatggctgcgacacaagtgagcaccatgtgaccaaaggtattgaattcttcaaaggtcttgatatctgcagtggcaccaccacctgctaagctgtctaagccagcaatggtcaatacttgtttcattgattcacatcctttagtctttcgttttattatagcgaatggagcaaaaataaaaacagccaattggctgtttttttacccatccaattggctgctgcttattgattatttagtaagttccgttcacgataccattcatctggtttccaaatccattcaaagccatcagctgctaatagatcataggcggcttttggtcccatggtccctgctgaatagttcggaaaatcaggtgtttctttatcccaagcatgtcggatgacatcgacgatgcgccatgattgagcaacttcgtcccaatgagtaaagttggtgccgtccccattcaaagcatctaagagcaatttttcataggcttctggcgtattttctacgatttcagtactattgcggtaatctagtttaacaggaagggtgtcgaatccttgaccgatttctttgccatttagagaaagtgaaaagccttccgtcggttgaatataaatcgtcaagacattaggtgctaatttcttcttgctttcgcaatcagtcacatctttcttgaaaacattcactggaacttgcttgaaaacgatattgatacgggtgcctttctctgttaaacgtttccctgtgcgtacataaaaagggactcctgaccagcggaagttgtcgatcaaaaacttgcctgcgacaaatgtttcggtggcagaatcttccgcaacattcatttcttcacgatacccagcaaactgctgatcctctaattgcccgtgagcatactgtccgcggacaaaattggttttgacttcttcttctgaataaatgcgaatcgcattcaatgctttgattttttctgtacggagttctttttctgagaaagcgactggtggttccatagctagcaaagagagaatctgcaagatgtggttttggaccatatcctttaaggcaccactcttatcataatagccgccgcgttcttcaacgccgagatcttcagcgatattgatttgaacattgtcgatatagcggttgttccattgcgattcaaaaatattattggcaaaacggattgcagaaatattttggatcatttcttttcctagatagtgatcgattcgatagatctcttgctcactgaaaacttgattgatttcttcgttcaattgtttcgcagaggcatagtcacttccgaaaggtttttcaatcaccacacgatggtagccttcggtttcaagcatgccttgtgattttaaatgtgagacgatggtaccaaagaagtttggagacattgccagataaaacagttggtttccttcaagctgatacttctgatctagagaatctgcaagctctttcaatgagtcatagtgagtggtatctgtcacatcatgagactgataataaaaatgtgaagcgaaagtctcagcttgttcttttgactcgatcaaatcttcgatcgttcccataacaacttcacggtaatggtcatctgaccaaggacgacgagccgtaccgattacagcaaaatcctctttaagatcgccttttttatacaaacggaagagggaagggtaaagtttgcgttgtgcaaggtcaccggttccgccaaaaatagtaaaaagcacctttttttccatcgttttcactccttacaatttatctacaaaaatcgtactagctgctttataactgacagcaatttctttatccgcatttttaatggtgatcggtccttcgtaggcagccgtatcaatgatctcaaactcttcatgaatattcaggtcgatggctaccagatagtccaacaattcccgttcatccaacacgcgagcaatccggatctttgtcccgacagggtaagcactcatcgtcgttttttctccttcgtggacgggttgtccctgttcggggatcattccgccgtgaggacaaaacttaggatgtcctagataggcttctaaatgatcagccaatgtccctgatgtgacatgttcaagtacctccgcatcatcgtggacttcattccaagaataattcaaatgctccactaaaaatacttcccataaacgatgtttacgaatgagagcacttgccgaagctagtccgctttcggtcaattggacgccttgataaggagagtgttccactaagccttcttttaaaagcttagaaatcatctcgcttactgaagcagcagacacatccagaccagaaacgatttgtttgttgttgattttcttctgatcaccgcccaattccaagatgagcttcaaataatcttcgcggtttggtgtcatggtattcatcctctcttatcaaagactatcaaactaaattctatcaaaaaaagccacagattactacggaaaaaaccgtgggaagaaggttttttataaaccgctttactttattcgcttattctgacagtcagtttttttaagaagaagaaaactgagagaatgattcatcctctcagtctttttagtgtgtattaagcccaatcgccatttctgaatactgggactgttgtgccatcttctttgattccatcgatggacatttgggcagatcctaccataaagtcaacgtgtgtttggctgcggttgagaccagcagcggccaattcttcttcgctcatttctgttccgccttgtaagctgaatgcataagccgaaccaagagctaagtggtttgaagcattttcatcaaaaagggtgttgaagaaaatgatcccggattgtgagattggtgaaggatcaggaacaagagccacttcgcctaaatgttttgcgccttcatcaatggctaataattttgctaaaacttcttctccttgttctgcagagaaatcaaccactttcccatctttaaaggtgaacttcatcccagagatgatcgttcccgcatagcttaatggtttcgtacttgagatatagccatcgatgcggcgactatcaggagcggtaaatacctcttctgttggcatgtttgccataaacttttcgccacgggcattgaagctgccggcaccttcccataaatggttctttggcaagccgataataatgtctgtgcctggggcagtataatgcaacgctgtgaattgttcttcgttgagttcattagctttttcttgcaacgttttatcatgattcttccaagctgccacagggtcttcttcatagatgcgcgttgttttgaaaatttgatcccaaagcaagtcttgcgcttcttctggtgttgcatcagggaagactttttgtgcccaatcttgaccagcggctgccacaaccgtccagctcactttgttggcttgggttgcttttcgcaagttaatcatggctttccccgaggcggcttgataagtcgctacgcggtctgaatctacacctgctaatgcatcgggattggctgaaaccacactgatacggctcgcaccttttgctacccaatcgtctgtttgatcgattttgtattgaggaatcgtttccaagcgatcgctgtcggcgtgggcaagaaattctttttgaacgacatcatctgtccattgaacgatgacttctgctgcccctaatgcataggctttttttgtcaaaaggcgagccaaaggtgcttgatcaacagcgatttggatgacgatcgtatggcctttttgaacattgacgccaacttctgtgattagttgggcatatttctcaagattttgattaaaatttggtaaaaccattaaaattcctcctaatttttctaactataactttctctatgatagcactatttttttttgaaaacaaatgaaatcgaagtcaaaaaaacagattttttcatgctgaattggaagcaaatagggactaggacaatcttaaaagttgttttgcaatcttaaaaaaacatgatacaatgaataaaaggtttttctgaaagcgatgtatagcagaattaaggagattaaaaaattatggcaagaaagaaaacaattactagagaccagattttaaaagctgcctatgaagttgtcgcaaccgaaggattcacacgttttaccgcacggaatattgcagcgaaaatgaagtgttcaacccaaccgatttacttagaattcaaaaacatggatgaccttaaaagtgccttgatcaatcaaatttatgattatctagcaacagaagtatttcccattgagagacgtggggacgtgatcgtcgatctgactttgaattacattggttttgcgaataaagaaaaacgcttgtatcgcgcgctttacctggaagagtatggcggtggcgattccatgcaaaaattttcttttgatttattcgtcaaatctgtgaaaaaagatccgaaatatcaggatttaacagaagtcgaactgaaatcattgcatacgggtgtatggatcgttgccactggattagccgcattgatgtcttcgggaattcttcatccgacggaagaccaaattgcaaaattgatgaccgagaccgcagaaaatatcattcatcgagaaacaccgattgatatttcatacaagtcattcgatcaataattaaatcatacgtaaagagaaaaaagcatgtacccagcgtgggatacatgcttttttatgtatgcgcatcaaagagatgcaacgatttttttcgcaaagtcttctaagttttgaatgtcttcttcttcggcagccaaatcaactttgacgctttctgctcctttgatagcaccggtcttggcaaaagctgcttcaaaatcatcgacagatttgcaaaaatcatcgtagaacgtgtcacctgaaccgcaaacaccaaatgtttttccactcaggtctaattcttgcaagtcttcatagaaatcaacgatctcgtctggcagttcaccatcaccataggtataagtggctacgatgcaaatatctgcctcttcgaattcatcggcatctacttgcgtacattcattgatatctacctcaatagccagattttcaagtgcttctgcaacgatatcagctatttcttcggtgttgcctgtcatgcttgcgtaaacgattttagctaaagtcataaataagtcctccgatcctttaacggtcaacagtaaaaaccctctctgattatagcaaacccagtcaagaataacaattcttgaaaaaagtcttaggtgaatcagcagactttgtaaaattcttgctttctatggtaaaataagaggaatttaaataagggagacgagaaaatgataacattaaaatctgccagagagattgatcaaatggctgagtccggcgcattacttgcggacgttcataaacaacttcgtacgtttattaaaccggggatcactagctgggatatcgaagtatttgtgagaaattatattgaaagccatggcggaatcgctgcacagatcggctttgaagattataaatatgcgacttgctgcagcatcaacaatgagatttgtcatgggtttccccgaaaaaaagtattaaaaaatggtgatctgatcaaagtagatatgtgtattgatctaaaaggcggaatctccgattcttgctggagttatgtcgtaggtgaatcgaccccagaaatcgatcgtttaatggaagtaacgaaaaaagcgatgtatttgggaatcgaacaagcacaagttgggaatcgaatcggtgatattggtcatgcgatccaaacgtatgcggaaggtgaaggctatggtgttgtccgtgattttgtcggtcatggcattggtccaacgatccacgaagcaccaatgattcctcattatggcgaagcagggaaaggcctacgcttgaaagaagggatggtcatcacgatcgagccgatgatcaacacaggaacttggaaaatgaagatggatccaaatggttggacagcgtacacacttgatggtggattgagttgtcaatatgagcatagcttagctatcacaaaagatggtccacggatcttgacttctcaaggagaagaaggaacctactagaaaagaatggacggatgtcggaggaaccccaaatgaaatggatcgataaggcgaaaagcaatcaaaagcttatgcgatttatagaaacgacacaaacgcggatcacggaatctgaaatgggaacgacctcagttgtcgtagcctattatttattactatccttgtttccattgctgatcgcgatcggaaacttgctgccttttctttcaatcgctcctagtaacgtgctgccctatgtccaagaattgattcctggtcaagtgtatgaatttatcggaccggccattgagaatttgctgacttctggttccggcggcttgttgtctatttcggcacttgcagctctttggtcagccagccaaagcatcaatgcattacaaattgccatgaacaaagcgtttggtgtcgatcagcgttcgaactttattgttgttcgtgcggtctcttttgtcattattctcttgtttatgattgcaatcgtaggtgtgacgatggttattggtttagggaagatcattttggactttctacaaccaatcttccatattcaagatgatttgattgctaccttccaaactgtcaaatggcctttgacgatcattgcgttgctgtttatcttgatgctaatctactggttggtgcctaatgccaaagtaaaacttcggtcaacgcttcctggcgcagtatttgctacggcgggctggatgttgctgtcgcaagtgttcggcttatatgcccgcttttttgctgctaggatcagcggctatcaaatcatcgggagtttcattgtgttgatgatttggctgaatctggcagcaacgatcattattttaggcggcatcatcaacgcagttgtggaagaatatttatcgggacaagagatcaaagaacgaaaagatcccgtggaacgtatctcatcaaaacttgaagatacattttccaataaggagaaataaatgaaagtgagaatgagcgatggaatttgcatttaaatttattgtacgtcttttcatcacgatgatcatatctttgatattgacgcccatcattaaattgatatcctttaaaattggtgcagtcgatcgcccaggagaacgacgaatcaacaccaaaacaatgcctacagcaggaggacttagtattttcctgtccttctcttttgccttgctttgggaatttcgcgaaatgatcccatttaactatgtctggccaatgctcttaggagccgcgatcgttgtagtgactggtttgcttgacgatatctttgagctctctccattacaaaaggtctgtgggttaacgctagcggctttagaaatctattttgtggcggggatcaagatcagtactgtgtcgattccttatatcggtgtattcgatttagggtggttaggcctgccaatgacaattttatggatattggcaatcacaaatgctgtcaatttgattgatgggttagatggactggctagtggagtatcgatcatcagtttgataacgattgggattatcagttacttctttttgcctgattcagtagctgtttcaatggtgatctttactttagtcgctgccatcgtgggattctttccctataacttttatccagcaacgatttttctgggtgatacgggtgctttattcttagggtttatgatttccgttctctcattgcaagggttgaagaatgcgacgtttattaccgtgatcacgcctatgctgattctgggcgtaccaatcaccgatactgtctatgcgatgattcgacggaagttcaacaaacaaaaaatttcttctgctgataaaatgcatcttcatcatcgcttgctttctttaggatttactcatcggggagcagtattgacaatctatgcgttagcaatggtattttcttttattgcactgttgatgaactatgccagtaatacggcaattattctactgatcattagtaccgcatttgggattgaattatttattgaattgattggtttggtgggagagaatcgccaaccattgatgtgcgccttgaaatttctaggtaatcggcgctttcgtcaggaagttttgactaagagaacaggcgactcactagaaacaaccgaggagccaataaaggaaccaacagaatcaaaaacccctcagcggacctcgcgcagaaaacgacgggctaggcataaaaaataatctcggtccatcagtaaaagaacgatccttacatgacatgttcagttgaagctgaaagtcacgtgtgggtcgttctttttttgtatctatccctaaaaggattgtttgcgcaaatcgattatttcaacgttacgatcgacaacgccagattctgtttctaacataatcgattggaaacgctcatttaaattaagctttggttcttggtcgaaataattggctgtatagtctttgatataaataggtccaaccgcagatgagagagtaatggtgtaaggtgcgggaacctctttgtctgagaccagcaagaaacgaaaacttgtatcgagagaacagatccctaatttcgaataaggtccgacaccgtcatccagatccagcagtaaagcaccctcattgctatgatatccttctagtttgttgatgactgcttgtgacatttttagttccatcatgtgttcctccttctttctcttcaatttcattctaagagcatttccctcagaacaaaagtaatctgctttcagcttattgacgtcttgaggctaaaacgtctatactgaatgagaagttatttcagtgaagaaagaaggatggtcaatgccaagtgtacagcaacgagaaacagaaaaaatgggaacagtttatgaagttgaaaatgatagcggtgtcaaacttgtaacaagcccggaaggagcacgcttactggattggatcgtgccgattgatggcggccgagacttagttgttgggtatgatacgatcgcaggacaccagaaagcgcgttattatggcgcaacgattgggccagttgccggcagaattgcaggaacccgatttactatcgacgggaaagagtatcaaacagaagataatgataatggcaatacattgcatggcggatttaagggattggataccgatacttggaaagctgaaacatttgaaacagaaaccgcagctggcgtaatttatcggacagaacgcaaagacggcgatagtggatttccgggcaatgtttcatacacagtgacttatacattggaaaatgatgattcatttacgattacttacgatgccacaaccgatcagcctacactatataatcccacgaatcatggctatttcaatttgaccggtgacactagaaatccaatcgatgatcacatggttcaaatcaatgcagaatatgtggctgaaacgaatcctgatgtcacaacaacaggaaaaaaacaacctgttgctgatacgaagtttgactttcgtgtagcgcgaaaaatgggcacaacattacttgatgatccattcttattggatcatactcaggactgggacttgaaagtgacgagccctgatgaaaaagtttccatcacagttacaacggatcgaccggctgtagtcatctataccacacgagatggcgaagaaggagcaccaatgaaaaccggaccttttgcaaaccatggcggaatggctattgagacccaaggcgttcctggaacagaaaaatatcctcagtttggggagatcctcttacgtccagaaaaacctttccattctgtgactcgttatcgtgttttttattaatcatagataatatatgacctctgtcagttgatctcaaacactacagaggttttttttgacaattttcgattacggatgtaaacttaaatcgtgaacaagcaaggaggaaaaaatatgcaatcatcaagtgctcctataaaaatcagtgattccgaatgggagatcatgcgagtgatttggacattaggaaaatccgatgcccaagaagtcacggcacttcttagcgaatccaaagactggaaaacagcaaccgttaaaacattactaggccgtctagtgaaaaaaggcgtattgcggacagaaacccaaggaaaaaaatttgtttattatcctttggtttccgaggatgctacgattcaaagtgccacagagagtttattctctcatatctgtgcaaaaaaaatcggccaaacattggcagaaatgattcgtgaatcggaactaacgaatgaagatctaacaatgttggaagaggcactggcgcaaaaagaaccggtagccgctattgcttgcaactgtataccgggacaatgtcaatgtacaatgaatgaaggagaataaatcatgaaaaaaatctatcacattgaaggaatgagctgcgaccactgtgttgctcgggtagaaaaagcattgtctgaagtgccaggtgtcaaaaaagcaaaggtaaatttaaagaaagccaatgccaaagtcaaatatgacgaacaacttgttacagatgaagacatcatcgctaaagtaacggaggtggggtacacagccacggttgaataagtctctcgctgctgttcttgaaagatatggaatgaaaaaagttcatttaattgtttgcggaaagacggtaggcaacttctgtcaccccccaacgcgttccagcagggcgcaaaactttccagcaaaaaggaggagtttgagatgagccataacgaaatggacggaggacattcggaaatggatcacagtaagatggatcacagtaagatggatcacagtaagatggatcacagtaagatggatcacagtaagatggatcacagtaagatggatcacagtaagatggatcacagtaagatggatcacagtaagatggatcacagtaagatggatcacagtaagatggatcatagtaagatggatcatagccacatggatcatggcatgagtggaatggatcatagtatgcatatggggaatttcaaacaaaagttttggctttccttggttttagcaatcccgattattcttttatcccctatgatggggcttgaattgccttttcagttcacttttccagggtctgactggctagtgatgattttagccacgattttgttcttctatggcggtcagcctttcttgagcggagcgaagatggaactgcagcaaaagagtccagcaatgatgacgttgattgctatggggatcacagtctcttatgtctatagtatttacgcgtttatcgcgaatcatttcatgcatggcgcacatgtcatggacttcttttgggaactggcttcattgatcgtgatcatgcttttaggacattggatcgagatgaacgctgtgtccaatgcagggaatgcattgcaaaaattagctgaattattgcctgatgaagtaactcgcaaaaaggcagatggttctgaagaaaagataccactggacacagtgaagaaaaatgatcgtttgatcgtacgagcgggtgacaaaatccctacagacggtatcatcaaagaaggggcaaccacgattgatgaatccgcagttacgggtgagtcccgtagagtagcgaaagagtccggttcgaaggtaatcgggggttccgtaaatggaaatggaacgattactattgaagtaacaggaaccggtgatgagagctatctttcaaaagtaatggaaatggttcgtcaagcgcaggcggataaatcaaaattggaagctttgtcagataaagtggcaaaatggttgttctatattgcattggtcgtcggaattaccgcatttgtaatttgggtgttcgcagcggatttgccaacagcgctggatcggatggtaactgtttttgtcattgcctgtcctcatgcacttggattagccattccgttggttgtcgcacgttcgacatcaattgctgctaaaaacggcttattgttaaaaaatcgtaatgcactggaaaatgcccatgatctagactatttgttacttgataaaaccggtactttaacacaaggaactttctcggtcacaggaattgaaagctttggtgactatacagcagatgaactactagcctatctagcagggctggaacaatcggccaatcatcctattgctgatggcatcttagcgcaagcaaaaaaggaaaatgttcagccgaaggaagcgactggaatccaagcgcattctggtatcgggatcgaagggatgattgctggggagaaatggcagatcgtcaatcaaaaagggatcgaaaagtatcagacaaccattgatccggaccaattgaataaatatcaagaacaagggaacaccattagctacttggtgaaaggcaatcaagtcgaagggctcgtagctttgggagacaaaatcaaaccagaggcggtaaaattcatcgaaacattgaagaaacaggggattacaccagtgatgttaactggagacaatcaagcagctgctaaggcagtggcaacttatctaggcatcgatgagtattttgctgaattattgccagaagataaagaacgaatcgttgctgattatctgaataagaaacaacgggtagcgatggttggtgatggtatcaatgatgcaccaagcttggctcgggcaacgatcggtattgctatcggcgctggaacagatgtcgcgattgattccgcagatgttgttttgaccaatagtaaccctaatgatattctgcattttcttgagctggctcataaaactagacgaaaaatgattcaaaacctttggtggggagcagggtacaatattgtgacgattcccttagctgcaggaatcctagcaccaattggtatcattttaaatcccgctgtcggcgccgttttgatgtcactaagcacaatcgtagtagcaatcaatgctatgacactcaaaattgatgagtgacaaaaaaccgaatcgtttgtttccattgattctcttgtaagcaggagaacgaccgaaacaaactgattcggttttttagtcagttgagaatcgaagattctttggtaatttaacggcaaagccgtcgaaataaacctacaatcgaccagtgactttatgctataatgtgttcgttgagacaaggaggacgttgagaatggaactgaagaagttagaggttcccactacttcgatcactgaagtaaaaaaatctccgatggatgtatttaatcaagcgagagaagcgggaacagcagtatatgtattcaatcgtgaaaaagtggcgggggtcatgctgacacaagagcaatatgaaacactcttacaggaactggatcaacggccattagcggaagaagagccggatcaaccagctgtggcgggattggaagaattcttacagattatgcggcaagcattgatcacaggggcaacgatttctgcaaaaaatttggacgaacgaatggtcgcattaggctttattacccgcaaaacaggctttggcggtgtagttgacatgatcaatgaattaaaagaaaccggaaagattgtctatcaattgcgcaaaaagcccgatggaaaatctgtcagtgccgaagtcatcggcgagcaagacaatcaaacgcagctttttgataaattgatcatcaaaaaaatattccttaaagaaaactaacagttatgctgcagcataactgtttttttgcgtaagtgtaatagtgtgagtttagtcgataccgatagaaataatggctgagacaaaaggtgtgaaaaggatactcctgattaggatcaaaaagtaccatcagataacagctaagtctcagcctttttcagcgacccactaagcaaccgtcaaccaataggttttaccatctttggttcgctgcatgaatccgtattcgatcaaatagcggcgaacagtgacgtagtcagcaataaactgtttcaaaatatcattgacggcactttcggaataatttttctgagaatcaaatttttgagccaaaacactcaataccacgattttgcgtttttccttacttgggaattgatgaatcaccccatcttgatcgaagtatgtcgcaatgattttttctctttcttcgctggtgattgcataacgatcatccaacatggttgctcctgtatggggaagaacaaaatcttgttcctctaaatgtgccataatacttaaaaagactttcgcttgccgttctttttcttttaatttaaagcggtgatttcgtactgtcgaattagagatacctagacgttgcgcgatgacggcatcgctgagtccttgcgcaaataatgataagatctcttgttggctttctgacaaacctgtctgctcgcgacttaatgacagcaatgcattcagtaaaccaccatggacctcatttagatgtaataagatgcattttttggcggtataaaagcgatcagaggttggataaatctgtcctttttcataattaacatcgcagaataggcattgataatgtgtttttgtggaacgatacccatgttcatagtcagacaaagaggtggcgggaatagttttcactttaatcatctccttttgtttgtttatatactaacatttataaatatcgtttgcaaatatataaacagatggattttttattttttgttttagcgaaagtattaaattacggatcaaaatgtgataggattaacagcaataacaaaaggtaactttgtgtggataggagtgatacgatgacagatgtcagtcaacgttttaacaaagaagtctatcaaattgctgtttctttgattcgaaaatttgatgagcgggtatctggtataccagatattttgaaattaacattaggcgaaccggatttcaatacaccggatcatgtcaaaaatgctggtgttcaagcaattgagcaaaattacagccattactcaggaatggccgggttaacggatgttcgagaagccgcaagcctttttttaaaagaaaaatatcaattgagttatgatccgttatcagaagtattagtgactatcggtgcaactgaagcaatctctgcttctttattagcaattctggaaccaggagataaagtccttttgccagcacctatttatcccggatatgagcccgtgattcaactagctcacgctacccccatttatttagataccacagcgaacgattttgtattgtcaccggagatgttggaaggggctttgattgagcatggggatcaggtcaaggcggttatcttaaattatcctagtaatccaaccggcgtggtttattctcgtgaagaagttcaagcacttgcggaagttctgaaaaaatatcctgtgtttgtcgttagtgatgaaatttatagtgaactttcttacgacgcacctcatgtatcgatcgcagaatatttaccggaacagaccattttgatcaatgggttatcaaaatcacatgcaatgactggctggcggattggttttatctttgctcccgttgccttaactgcccaaattatcaaagttcatcaatatttagtaacggcagcctcaacgatttcacaaaaagcagctgtaagagcgttagttgaaggaatcaatgatgctgcagttatgaaagccgagtaccgtcagcgacgtgattttctctatgaaaaaatgacagcattaggttttgaaatcgccaagccgtcaggagctttctatttatttgcaaaaatcccaaccggttatgaacaagattcgatggcattctgtgttgatttagcagaaaaaaatcaattagcaatcataccagggattgcattcggacccgaagccgaaggatatgtacgcctaagctacgcagccagccaagagaacctgcaagaagccatgaagcgactaagtaattatatgaagaaacaaccaaatcaataaacacatcagagcgtcccaatgggacgctcttttgctgcgaatcactgcgattgacactcgaagagtggcagagcagatgatgagcagtactaggcgatcaaagagagcgtagtcacattcaaatgaatcactgcgattgacactcgaagagtggcatgtaagttcgtcttagcgcaaacacgctagaagccagtgcgaagcaaagtaagtgtagccccaatatggagtcataaagaacaacacacagcggcacttgtaccttttgctttttaagaaggaaccaggcaagctcttttcacttcaatgaaaagagaggaacaatgacgagcgatacattttaatgtttacaaaagatttacatgggtttatctattctttactttaaatcaatcatgggtttacaaggggttgctaaactaagcatataacgaaaggagatttaacaaatgaaaaaactgggattcttaattttagcaacaggactattactagctggctgtggaaatagcggatcaaatgctgctgatagcggtcaagcatcaaatgaatcaagtgcttcaggagcagcgtctggaaatgtagaaattttggctgttggatcaactgcactacaaccattagttcaagctgcacaagaaagtttcacctctgaaaatccaaactatatgattactgttcaaggcggcggtagcggcacaggactgagccaagtagaagctggtgctgtaacaatcggtaattctgatgtttttgctgaagaaaaagacggagtagatgctagcaaattggtagaccataaagtcgccgtagttggaatggctcctgtagtgaataaagaagttggtgttaaagatatcagcaaacaggacttgattgatatcttcactggtaaaaccaaaaattggtctgaacttggtggaaaagaccaagagatcgcagtgatcaaccgtgcatctggtagtggtacacgggcaacatttgaaaaatggggacttgacggggccgaaacaattcaaacccaagaacaagactcttctggaacggttcgcaaaatcgttgcagaaacaccaggagcaatcagctatcttgctctatcttatctggatgattctttacaagcattaacgattgatggtgttgaagcaactccagaaaatattgctacaaatgactggaaaatttggtcttacgagcatatgtatacaaatggcgaaccagatgcaaacgtcaaaacatttcttgattacatgttgagtgacgatattcaacaaggtgtcgtgaaagaattaggatacttaccaatcacagaaatgaaagttgaacgtagtgttgaaggggaagttacgaatataaactaagaaactatagttatcaatgaatagtcagagacgaaaagggcaaataaatgccctttttttctgtgtttttatgcttttttcctataaaatgaaaaggagtaaaattgaaaggggaaaaaaatgtcaaaacagacaaaatactttgtatatatttgtgcacttttgccgctactgtttttaggaaatacaggaactgttttagctatagaaattgaaagcagcagtcaaacacttactacagaaacaatgaatgaaacaagtgcctctaacacctcaacgacggatagcacaagtaccgtgtcgtcagatgcagagggagcttcgaataccagtagttcagaaaagagtagtcaagaaagtacaaaagaagaaacacaagcttcagatgaatcacagcaagaaacacaagaagaacccgaaaaaatttatgatgttcaaggtggacttgatccgtcgagcagaaatcgttccgatttgaaagaacaggtgggcattcagcggcgttctctgcgttcagcagacgtcgcgtttattgaagccggagacccatcgactcctagtcaggattttattgatgtctcttctcacaatggcatcattagcgtggaacaatacaagattatcaaaagttatggtatttcttccgtggttgtgaaattgacagaagctacttcttatcgcaatccattagcagcatctcaaattgcgaatgctcaagcggcaggactggtagtacatgcttatcattacagttggttcacgacagaagcgcaagctaaagcagaagccgagtattttgtcaaatatgccaaagaattgaagctgccaacctcagctttgatggttaatgatatcgaggacaatcaaataatgggaaaagcagatcatactgcactttctaaagtatttgccaatcgtatcaaagaattaggctatagtaatacccatcattacactggggtactttgggtcactcaaaaagcgatcgatcctgctgcacttggctatagtaatgtctggatcgcgaattatccgtatgttcctgcaggacaaaaattcacggaatatagtgcatggcagtggacctataatctttctttcccaggagtcagtgggaccttcgatatgtcttctgactatcagaaatactttactggtcaggggcaaggaggagcaataccagacaaccgctacgctacgattacgaaagataactacacgatttggcagaatttttcttggaagaaaaaagcagattcaaaagattatttgggtcaaacgttacaaataaaatatcgttacgagcatatcaatggtagtacgtatttttctgtgtacgataatcaaggtacttggataggttatattaatgctggtggaactaagacaactgatggcgcacaaggaagttggcagtcaaaagaaacgtatgtaaagtttcgttcgaccggaacggtttatcgcaattttaatttcgattccacagcaatagtatcagaagaaatgttgaggaatctttacaaggtaacaggcacctatcgtcattttaatggtgtcgtatatgattcagtatatgatctcaatggtaaatggatcggttatatcgattctgcaaagcttagtgtggagaatcaaggtccagctattagcgacgaacgctatacaacagtcactagtgcaaattactcgatttggcaaaatttttcttggaaaatgcgtgcgtcaagtagttcttatttgcaccagacgctaaaaattaaatatcgttatgagcatttgaacggcagcgtttatttttcattatatgacaatcaagacaattgggtgggttatattaatgcaaatgccacgaaagttgccgacaatgcagcgggtgctgtgttattcagtggacaatacggaacggttactagtaaaaattattcaatatggcaaaatttttcttggaaagaaaaaaataaaagtgctaacgtttatggacagacattgcaagtgaaacgctattataatcattttaatggcagtacctattattctttatatgataatcgaggtacttggcaaggatatattaatagtggtggaatgaagatggcggataatgcagctgggagtgcacaaagctatcataagaaaataaagttcacacaaaattttcctttgtggcaaaactttaactggaaaaagaaaagtaccgttacagatgcaatgaaacaagagacgtatgaagcaagatatgtatatcgtcattttaacggaagcaattacttatcaatttatgacaacaaaggtatttggcaaggttatattaatgaatcggccactcgccaagtaaactaaaaaattcaggacttgcgtatagattacgcaggtcctgaattttttttggtctcaagaggaagtgtgatcgtaaatgttgagccagcccctgggaagctgtcaactgtgatagtgccacctaacagtttcgtataatctttaacgatggctagtcctaagccggttcctcctgaattacgcgtacgagctttatctacgcgataaaaacgttcaaagatccgaacttgatcttctcgatctataccgatcccttggtcacgaactgaaagctgtaattgttttgctcgatacgaatagtcaacttggatggtcccttgtgatttggaataattgactgcattttcaatcaaattttttaagattggttgcagtagctctctttttgagatgaaaatcaactcttcgggaccattgatgataaaggacaactgtttttctcgtgcaattggttcataggagcggatgatttgctcaatcaatgctcgaaggttgatttcttgtgcggtgtaatcaaatgaatgactatctttggataaaagaataatctcttgaatcaaattttctagacgataggcatctttttggatgattttaaggaacgaaaccaatgtttctcgatcttctaaggcaccatccaataatgtttccgtaaaaccaatcaaagaagtgactggcgttttcaattcatgagaaacattaccgacgaaatctttttgcattttttctaattgacgcacccgagtcagatcataagagatccctaacaactcattttcattaaagagacgcaatgttacatcaagaactcgcggatgatcatcactcaaagcaatttcttcttgtaaagaaggggtctgctcgttcatgtgataaattaattgaatcaactgtgtatcatgaatcacttcagtgaatggttgtggcaattgaggcaatgcttcgatccctagctgctcttgcatggtagggttcagcaataacaatcggtcatcctgatcaatgataaaaaccccgatcatcagttcattcaacaggccatacaattgttgctcagaagcggcataagcttgataggttcgactcatttgttcactcaattgattgattgtctggtataagtcatcatgctcaggtgtttcttgcataatgatcgcctgttgatcaggagaagaaatcattttttttagaacaggcaaaatagtctgcacaggacgatttctttgacgtaacgcatgaaacgtcaaaaagctgacaaataaacaaaataggagataaacgaaaaagatcgaacgctgaatggtttggcttttagcaaaaaaaggtgccgttggttcagcgatccgcaaaatttgctgcaagttgccatcttctttgacagggatcgcaacatacagcaattcttcattcaatgtatcactttttcgcaaagactggcccagattactaccttttaagactgcttgcacttcaggccggttggctctgctttcttttaaagacgaatcgtaagtatcgtagatgatccgcccatccttgtccaataaagtgatccggctggaactatcctgtacataggcatcagcaaattgttgcaatgtcgctggttgattatcagaaaggttcaagaaaatcgccgctttttcttccaagaagtctacttgttgggcaatcacttgctggcgatagaagctgctaagaaattgccagcagatgataaacagtacggctaatagcagactccataggccatagccaaagcgtttcatgaatgaggctcctgaaatttataaccaaatccgcgaactgtcactaaatactcgggatgtttcgggtcacgttccagcttttcgcgtaaatgactgatatgcacatcaacgattcggctttggccatcaaagtcaaaattccaaatgcgattcagcagcgtatcgcggtcgatcacacggcctttccgtttcatgaagtatattagcagttcaaactcttttggagtcagaaaaatcttttctcccttgacgcttacttggtaattggtcaagtctgctaaaatgtcaccaatttgcaacatttctgctggctgatccgaaagatctgcagtgcctcgcggttccaaccgtctaaagattgctttcatccgagcaagcacttctctagggctaaagggcttggtcaaataatcatctgctccgatttcaagcccaagaatccgatcaatcggatcatctttagcggttaaaactaaaataggggtctcgattttttcttgtcgtagtttcttggtgatttcgataccgtccatttgcggcaacatcacatctaagataatgaagtcaaaatcttcagatagtgccagatcaacccccattttaccgtcgacagccgaaacgacttggtatccttctttttctaaattgaatgtaagtaaagtaacgatagatggttcatcatctaccacgagaatttttttcatcatgaactcctttcttaacaaaggaacaatcattttacgttgttctagctatattttagcatgaataaagaattggtactattgtctaccacaaataaatgctataataaaggacgatttgagaagaaagctgagggtgttcgatgattggaatcagtgcatgtttaggtggggtcatgtgccgctatgacgggcagcatcaagcggttgctcaactggttgaactcgttcaaactggtcaagcagtgatggtctgtccagaagtccttggcgggttgccaattcctcgtgagccagcagaaattgttggtggggacggtagagatgtttggtcacaaaaagccaaagtcattactgtcactggagaagatgtctcagaacaatttatgaacggcgcaaagcttgcctatcaaaaattacacgatcttgggatcacgcaactgatcttaaaagaaaaaagtccttcttgcggcagtcggattgtttacgacggcaatttttcaggagtcaaaaaagaaggtgttggtgtcgccagtgcttattttcaacaacaaggaatgaccgtgctgtcggatgtcgactggcttgctgagcaggaggaaaataatggagattgaaaaaaccaatcgaatgaacgcgttgtttgaattttattctacactgttaactgagaagcagatgaattatatggaattgtattatgcagatgacttctcattaggtgagattgcagaagaataccatgtaagtcggcaagcagtgtatgataatatcaaacgaacggaaaaaattcttgaagactatgaaaaaaaactacacatgttttcggattatatgatgcgggaagacttgttggagcaattatctgagtacaccaagacgcactatcccaaagatgaaacattgcgctcgttgatcgaagagatccaagaaatcgaagaataaaggaatgaaaaaagatggcatttgaaagtttaacagaacgcctacagcaggcgatgagcaaactgcgtaagaaagggaaagtttctgaagcagatgtaaaagaaatgatgcgggagattcgtttggctttattagaagccgacgttaatttacaagtagtcaaggaatttaccaaaaatgttcgtgaacgtgcagttggagcagaagtcttagacagcttatctcccgcgcaacaaatcgtcaagatcgttgatgaggaactgaccaaaacattaggttctgaaacagttggtattgagaaatcaccaaaaatcccgactgttattatgatggctggtctgcaaggggccggtaaaacgacatttgctgggaaattagccaaccatttgatcaagacagaaaatgcgcggcctttgatgatcgcaggggacgtgtaccgtccagcagcgatcgatcagctgaaagttttaggccaacaattagatgtaccagtttttgatatgggaaccgatgtcagtcctgttgagatcgttcgtcaagggatggcattggcaagagaaaagaaaaatgattatgtcctaatcgatactgccggtcgtttacacatcgatgaaacattgatggatgaattgaagcagatcaaagagttagcacagccgaatgaaatcctcttagtcgttgatgcgatgactggacaagatgccgtgaatgtcgccgacagcttcaatcaacaattaggtattactggggtcgttattacgaaactagacggggatactcgtgggggtgctgcgctttccattcgacaagtgactggtgcgccaatcaaatttaccggtactggggaaaaactgacagacttagaagtctttcaccctgatcggatgtccagccgtattttaggtatgggagacatgttgacgctgatcgaaaaagcccaacaagattacgacgagaaaaaagcagaagaattagcgcaaaaaatgaaagaaaattccttcgacttcaatgactttgttgagcagatcgaccaagtgatgggcatgggacctatcgaagatcttttgaagatgattccaggaatgagtcaaatgccaggtatcgaaaacgtcaaagtcgatccgaaacaaatcgcgcgtcaaaaagcgatggtctattcaatgacgcctgcagaacgggagaatcctgatttgctgaatccaagtcgtcgtcgtcggatcgcagcggggtctggaaatagcgtggtcgaagtcaatcggatgatcaaacaattcaaagaatcccgaaaaatgatgcaacaaatgaccaaagggaatatgaatatcccgggtatggatcaaatgtttggcggcggtgttaaaggaaaattaggtaaaatggccatgaaccgaatggtcaaaaaacaaaagaagaaaaagaaaaaacgtaaataattaactgaaataagcaagcagccgttatgctgatcaccatgaaaagtatcgaaaagattccaggatcatttctgatactagaagatggtttggtcgacaacggttgcttttttcgtttgcggtcttctgttcgtcagttgcttgtttggaaagggaatacctatcagttggatcgatagctgaaacgtaatatagcgacctttgaacatgtatcggctgagcaaggatagatggtttaactagctgatccaagtagattcattaagtacttgaacgcgttgcaaggcaaaatattcgtgctttagacggatagatgctactatttatttatagtaattgaaaggagcaagtgacgatgacaaacaaagatcgagttgaaggtaaaattactgaaacaaaagggaaagttacgggcgatgactccgaaaaattaaaagggaaaacccaaaacgaatacggtaaagtgaaagataaagtagaagactttgcagatgacgtttctcgcaaagtgaatcatttctttgataaacatgacgataaagataagcctaaccgctaatttaactgaaacaaccgttaacgatttcgttaacggttgtttttttcttttaaaaaggaagactgtcaaagaagtgctagctgacagtccggctattcataaagcgacgagcatgccaccattttttgattgctttcggataaaccaataggaagctgactacaagacagaccactaagtaaatacaaatcgaaacgatagttctcgtttgagagaagtcatcataatagagttggaccagcaaccaattcatattgatcaagtagaaccaagtaccaatggccatcactaaaaagacgggcaatcgaaaggcgggaaccgtcagatagtcgccgtcattttctaaggagatgcgggcaaacacttcttgagcagcagcaatcaacaacaaggataggagtagtgtggcgaagactgcccaccaattgactggtaagccattgggccagtcattccaaagattgttcaatactaagtgccccccttttccatagaagaaaaagctgagaaattcttgcagattatagtaaaaactgtaaaaaccgctcatcaagaaaaaaatcaaaacgatcgttaatggaccgaaaaagagattgcccaaaagcacccctaagaaggatccgatggctgtcactgccaaatttcctacaaacgtaccaacaccagatgcgaatagatctgatagcggaatttggaaatattcggagggaatcatcaagtagcgaatgcaaatattgctcaaaataccaatgattaaagcgaaactgaccggtgcaaataagaaaaccgctttttgacggaaaatctgtcgttttttaaacggcaatgagaataaaaaacgattgaaatttgtcttttgatcaatgaaaaaactaagaaaaccaaaaacaaacaataatggaagaataaaataagcgcctgaggtattgaaattagcaatatacgtatcctgtccattactttctggtaccggactattataaatgagcaagttttcatccttgtattcatcgatcgatgagtaatagactggtttttctccgttatagtccttaatatagtaatcaggatgctcttggaaatctttcttgaattcttctgaatcaaaatagttcttttgattgtgccaagaacgttgggtatcccagcccattcctgcataaatcaaaaccaagatcagacaaaagccaagcaacagtttgccatatcgctggcaataaatttgttttaacattttctttcacctctaacctttcaacagggattcttgactcaaattggcttcaaataaatcttccaaggtcaatgggagttcttcaaagagcaacggctctagttgccggatctgttcttctaatgccgcgtcgtattcttcgaacaaagcaacaatcacccgcccttgacgattgatcaatttcgaatgctgtttgatcattggcggtacctgtttcccacgaaagacgaattgaattttacgggcattttcccgcatcgtttctaaccgataatctttagcgattgttcttcctttgattaaaagggctcggtcgataatgttctcaagctcatttagattatgagaagcgatgatggctgtgcgattagattcactcaagttttctaacaaaaggccaatgacctttttgcgtacaataatatctaaaccgtcaaaaggttcgtccaatagcaagtaatcggcatttgaagcaatggctaagatcattttatacaatccttgcatgcctttagacattcggcgatacgaatggccaagcggcaatccattgctctgcatcagctcaagataaaggttttgattaaagtgggaataagcgagacgataaaaggcattgatttttttcaatgaatacgccgctaaaaagttctctttttcatcgatataaaataagttttcctttagttgtggcttctgggccaatgattgaccatcaatcatgatttcgccgccgtctaaagcgtactgtcctgagagtgtacggaaaagcgtggtttttccagagccgttgcgcccaatcaagccaacgatttcatttttgcgcaatgaaaatgtaacatcttctagaatagtagtcccttcaattttctttgtaacgccttctaggttcatttattgatccctcccagttcttcttcaaaaacagtgacccaagcagtgatttcttggatgctgatctgcaaatgtcctgcctcgatcactaattctttcaatcgttcttttaattgttggatgcgccgctcgtcgcgtggaacactgtccagtgctttgacaaacgttcctttgcctttgatggtgatcaagacctgctcattttctaatattttgtaggccttgctgacggtatttggattcatcaacaagcgtttggccatctcacgaaccgaaggaatttgatcacccggtctcaaaacaccatgcaagatgtcttctttgatgctcaatatcagctgctcgtaataaggtttgctgcttgtcttgttgatcatgaccatgtactcagcccctttcatttatgtgtactagtatacgtagtacactatcaaaagtaaagaacttttgctaaaataagacaaaaaggaggagtgactatgactcgttgtggttgggcaacaagtagtcccgcaatgcaagagtaccatgatcatgtctgggggaaaccggagtatgatgatcagcagttgtttcgtaagttggttttagatatgaatcaagcagggctgagttggcaaacgattttgaacaagatgtcaaattttgatcaagcatatgatcactttgatattgagacagtagccaattattcggaggaaaaaattctagcactgatggatgatcccggtattattcgtaatcgcagaaaaatagaagcggcagttcataatgcacaactcgtattagcgattcagcaagaaatcggaagtttttctgattttttatggcgttatgtcgaccatcgacccgtcatcaatcattttcaaacacaatcagaagtacccatccattcaccaatttctgatcgcttggcgaaagatttgaaagcccgtggctttaagtttgtaggaacgacgacaatctatgcattcatggaagctgtaggaatggttaacgatcacctgacaagctgtatctgttacgaggaacgttagaaagaagagaaaaatcgaggaggagtcttatatgggaaaactggttttttatggcgctatcagtttagatggctatttagctggagcaaaggatcaattggactggttgttggagaccgatacggggataagtactacgtatgagaaattttttgaaacgattgatgcaacagcgatgggccgtaagacgtacgaagaagccaaaaaaatgttggcgacggagaagctctatccagaaaaagaaaattatgtgttttcccgtcagatgcagaccgatttaacggacgcagtagttgtggatcaagacccggttgcttttttatcacaattgaaaaaagagaaaacggtttggttggttggcggtggaaagttattgcaccctttattggaagcagatctgattgatgaatggtatgtacagatcgctcctgtgttattaggaacaggcaagcgcttgtttgagccaggagagtatactactcgtttacaattcgtggatatgacgcaaatgggtgaactcgtagagatccactatcaacggaaatagatggcttgctttctgagtttctctttttctgtgttgcagatacttccttatgattcactcagagtttacattgaaccatccagcaaaaaaacgcacactcactggtttcccttatgggatagatcagtgagtgtgcgtttcttatctgactgtcacaaaatcgtgaccggtttttagttgtaacggttaaacaagtcgatgtagttgtcaacgattgtttggaagaagttgacggtatcttctttgatcgtattgttttcatcgatcaagttcatgattccaccgatataagcttctggttgttgcaaagtcggcatatctaagaataccaatgattgacgcaggtgatggttcgcaccaaaaccagcgatcgcacctggtgaaacacttacgactaaagcaggtttcccgctccagctgcttgctccataaggacgtgaaccgacatccaaggcatttttcaatgctgctggtacagaacgattgtactctggtgtaaagaagaatacaccgtccacactttgcaattcattacggaatgttgtccattcagtaggcactttgccttctacttccaagtcttcattataaaatgggagattgccgatttctaaaaagacagcttcgaaaccttctggcaataattctgcaaatttcttcgctaccagcttgttataagagccttcgcgtaaactaccaacgataaaaccaattttttttgtcatgttgaattcctcctcatatcttttacatgttttatcttaccaaaagtaagtaaaactgacaaataaaaagcatttgcctagaaaatccattcataaagcgatgtctcagctataatgactgtctctctctaatgatacgcgttgcaggaaaatctggcaaaagataacctatagaagaaagaaacagaaaaaaagagactgtaaagaaaaaactctttacaccgtcagtaaaacctgttaaactagctcttgtgattaaaacaatggaggtgtaaataatggcagtaaaaattcgtttaaaacgcatgggttctaaaaagaaacctttttaccgtattgtcgtagcagattcacgttctcctcgtgacggacgtttcatcgaaacagtaggtacttacaatcctttgcaagacccagctgaagtgacaatcaaagaagatttgattcttgattggttatcaaaaggtgcgcaaccttctgatacagtacgcaatattctttcaaaagaaggcgtaatgaaaaaacaccacgaagctaaattcactaagaaataaggtgacgacggatgaatgatttgcaagaattagtcttaacgatcgtttcaccattagtgaccaaacctgaggagatccagcttgatgtggttgaatcagaagatttctttgaatataatcttacagttgctccggaagatatcggacgaatcattggtaaacaaggtcgggtggctaaagcaatccggacgatcgtttacggggttcgcaccaacggccccaaaaaggtccgtttaaatatcattgatggaaagtaattgatcgcgtcactcattgagtgatgctttttttctatcctgttagttcatgctcaagacctatgacagatcggctgatttttgagataataagaaaaaggaggcgggagtatgtcacaagtgattgcatggatcctatttatttttgttttgatctttatttataaagtggggtcatttatctggcgcatattaggcgtattgtttttgctatttttactatggatctatcgggatgtcatctttacacaagttagtcaatggacacgagatttccgctgggatcaactaccaacttatttggaccaaggaattcaatgggtaaaagacggctggcaagccttgcaaagctggatttcgaataggattagctaggaacaggagacaagcaaagttgtttgtctttttattttggaaaaggtatgctctataaaaagggggaaatcatcatgaaaaaagaaataggtctcctagtgacagtattggccattggggcattagcaggatgcgacacgaaaaataatacggataagtctgagtcaacccgttcaagcactcatactagtacaaccatttcttctgaaagcagtagcagtagtagtgaggcagcctccagcagtgccgcgcaaacttcaagtaagacagttaccaaagcaggaacactggatcagttgtcagctgcttttccgcaggatcgcttgccatcagaggtgccggtgacggagcaaaagaccttgaatgctgcaaccgacgaaggggcagatcaactctctatcctctattatcagttaaatgatcaacgagaattgaatgatccatcattgaacaatgagacaccaatcgctagctacaaaaatgctgcttacgaaaatgaagaccaagcggcggaggctgtacatgcgaaccttgatgaaggcggacaggcggtcgatctaggacataacatcactggtcatatgcaaggtgcagctggttccagttatctaagttggcaagaaggcaattggaacttgacggttcgagcagtcaatcaagagaatcaagatcccgtgccagtagcaaaaaaaatcgtggcctatttagaagaagctatgctgcccgctccaggaattggtcaaatcaccattgatatgggaaaatcagattacacggctaacagcgtttcttggcaagacagtaagatcacttataccttgcaacatcaagatcctttatccgcattgaaaatggctgtctcaatgaatcaataaaagagccaatctaacgtgtaggaggaagtcatgcagattacgtatttatctgatcctcaagaaaagaaacagatcgcacaaaccattctggctgatttgccggaatggttcggcctgcctgaaagcactgccgattatattgaaaaaagtgcctatcaagaaatgatcgttgtagagaacaaaggttttttgacccttgtaaaaacaagtccagcgactgctgagatctatgttatgggcgtattgaaagccgatcaccatcaaggaatcggcagccaattgatccaagaagccatccgttggtgccaacgagaaagtatggcctttttacaggttaagacattggcagagacgcatccagaccaacactatcaacgtacacgaagtttttatgaggcgatgggttttttttgcctgtcgaaacatttcccaccctttggggagcggaaaatccatgcttgttgatgatccaagcagttccacctcgggaaaacactagaattccttaactccccatgctaaaatgagaaggattataaaggaaatgaggaccaatcgtgactgaatttttaaatgtaggaaaaattgtcaatacccacggaatccggggagaagtacgagtgatctcgcaaaccgatttcccagaagaacgctaccgtaaagggcaacgattaacactgtttcgagaaaataaagcaccgctggaattaaccgtcgctggtcatcgtaaacacaagaattttgatttattgacattcgaggggtaccccacgatcaatgatgtggaacctttgcgagacggtatcttaaaagtttcaaaagacgaattaagcgaactaacagaaaatgagtattactatcatgaaatcatcggcttgaccgtcattgatgagcaagccagagaactaggaaaaatcaaagaaatcctatctcccggtgccaatgatgtttgggtagtccaacgcaaaggcaaaaaagatgcgttgattccctacatcgaatcagtggtaaagcaaattgatttggataaaggcgaagtgcatattgagatcccagaagggttgttggatgatgaggattgatgttttaaccttattcccaagaatgtttgacggcccaatgggggaatcgatcattggaaaagctcgggaaaaagagcttctagaaatcaatgtctcaaactttcgcgaattttcggacaacaaacaccaaacagtagatgactacccttatggcggaggggcagggatgctgctgaaagttcagccgatctatgataatttaaaagcgatcgaaactgccaccccgcaaaccaaaaaacgtattatcttgttagaccctgccggtaagaaattcgatcaaaaaatggccgaatctttttcgcaagaagagcatctggtatttatctgcggacattatgaagggtatgatgaacgaattcgttcgctagtgacggatgaagtttctctcggggattatgttttgactggtggcgaattaggcgcgatggtgatgatcgatgcgaccgttcgtttgctgcctgaagtgctaggaaacgagacgtctgcgcagactgattcccactccacagggttgcttgaacacccgcagtacacgcgaccagcagaatttcaagggatgacggtcccaccagtcttgatgaacggcaaccacaaactgatcgaagaatggcgcttaaaagaatccttgagacgaacttatcatcgacgacctgatatgttggcggattatcccctaacagcagaaatgaaaaaaatgctacaagagatcgacgaagaagcttcggcagaggatgaatcaaagtaagaaatctcagtatctagaatcgcacctgcaatcaaatgaaaccaccacaacggatactagaagcaccagtctagtccgttgtcttttttatagagacaaaataaatgtcgggaaaaaaagctggtgacaagaaatttgtctttacatgagctggaaagttatggtaagatatttcagtgagtgtaaactcaactattacgatattccgctggagcaaattgctttaagaatgtttgggaataaggagaatgataaagatgaatccattgattcaagaattaactcaagaacaattacgtactgacatcccagctttccgtcctggggacactgttcgcgttcatgcgaaagttgttgaaggaacgcgcgaacgtatccagttatttgaaggtgttgttatcaaacgccgcggagctggtattagcgaaacttataccgttcgtaaagtatcaaatggtgtaggtgttgaacgtaccttcccattgcacacaccacgtgttgcacaaatcgaagttgttcgttacggtaaagtacgtcgtgcaaaattgtactacttgcgtgcattacacggaaaagcagctcgtatcaaagaaattcgtcgttaatcatttattatcagatgaagcaaaagcccttgttttcaagggcttttttcttttggtcaggaggggtctatcatttgctttaatgcctcatgcgcaagtaaataaggctgatcatgtagctgcatattttttaacagtatcccgaaaattgtcttttgttctgactgaggattcgattgaatccgaagaaaagtttgattagaatctcgaaaaagtcatgaaagtcgataaaaattatgctatacctaaacaaagataaaaattgaaatgagggatgaggatgaaagtcacttatttgggtactgctgcggcagaacgtgttccagccatattttgtaattgtaggatctgccgtcatgcgatggagaaaaaaggccgggagattcggacccaaacgcaagcgttgttggatgatggcaagcttttgatcgattttcctggggacagttacctgcaccgattgagtggtcgagtggattataatcgcgtcgaagcattattgctgacccactggcactcagatcatttttacggagaagatttagcttatcgaatgtccggctatgccaatgggatcacgactcaattggctgtctatagcaatgcctatgtgaaaggtttttatgaccgagcgttccaattggaaggacgttacgatgaacaacgcctgacgtatcatcttttggaagcgtatcaaaaaacatggatcaatggctatgaagtgtattctttaccggcacaacatggtcattttgccgaagattgttttatctatgtcatcaaagatccaacaggcaaaacacttctctatggacacgatacaggctacttgacggaagagatgtttgcttttttagaagcaaataagtttatttttgattgtgtatcaatggattgcacggggcagaccaatgctgaccagatggccaatcatatgaattggtcgcaaaatattcaaatgaaacaggagctgatggatcgcaagttagcgactgaaaagacgatctttgtcgccaatcatttctctcacaatggagggagaacctatcaagagatggcagatctctcagcttcagaaatgatcattaccgcatatgacgggttggagatccatctttaatccgtctgacgattaattcatgaatactgaatgtcaacaactcataagggaggcaaacaataaaaatagatcatgaaaatagcgtgttaagtgggaaacgatgtccagcgagatttaggtgctagagaaatgagtaaataaagaggaatgatttttcatgagaaatcagaaatttgaatactatatgcgagaattaaacctgattaaaagacaaaactggattgaaaatgacctatatcatctagttgcggaaatgattaaggctggcaaaaatatgtctaggctatctttaagagatgtaagcttgcgaagtaggagtccaaaaggtcagatattctatggcttatcttcatttcctgattttgtcatcttggatgaacggtttgataattcagataatcttgccgggggaagtgtaaatatagcgaataaaaatttgatttatggctgcgttgaagtaaaaaatgtcgatgagaagctattagatctagaatcaatcgatctaatatcagaatttgagaaagcaaaaaaaccaggaaatgaactgaatcaagatttaggccaactcttaggacaaatactatggtttaaaaaagttttgtatacaaatggcaatatatggaaattctacaaacgaacaagtcaagaaacagataactttcttactgacaaatgtatagaaaagttatttgaggatcgtatgaaaaatgaggcccctgattacaaatggtatgtaggactagatgacgataatttaaagattgaaaaagtttttgagtttgtcttagagagtgatataaaaaaagaagtatgggaagaatttctaaatagcttatattcgattaactgggaaggataaagatgctattgtggaagaataatcatcttttagaaatgaatcaggttgttttacttgcggctcaatggattgcagggggcagaaacatgctgattcaatggccaatcatatcacaatagccgaatgaagcaagaatggatggatctcaagggattgactgaaaaagggatctctgttgccaattacttctcacaatgggtgaacttatcagcaaataacggatctctcagcttcagaaatgattattaccgcatatgacagggttggagagctatctttgagccacttggaaatcgtctagcacgtataacgctatcgtcagtttaataagcgagttgaggacctatatttgatctcctcgattcgctttttttgatagtctgagataaaccgcttgctgatgaaggagtgtagctaataaaaaaaagataccagttgaagtgcgaaaaagaaaaaaatagaagttgttcttgaatgaaaatagttggaaaatcatttttcattttcttttatgcctgttaaagtcaatgataccaatcatattaacaagaccaaaaatgaaaatacaaaaaaaactgttcttagtattgactcataaaaaataccactactatacttgtattgtggttataaccagttaggagagacatcgatgcaaaatacatttcaatcaaaatcactttattatcagctggtagaaatattgaaacaacgaatcgaaaacagtatggtcgctcatgataagctgccatcagaaagagagttgaccagtttttatggcgttagtcgcacgacggtgcgactagcattgcaagaactggaaaaaatgggctacatttatcgacaacatggaaaaggaacctttgtttcggaattaaggacaaatgcgactgatctagctggcgcatatagttttaccgaacaaatgcgggcaatgggcaaacatcctgaaaccaagatattggccttcaaaaagattgaagcaaccaagtatttagcggggcatatgaatgttcaattaggtgaacctttgtttcagttagaccgtttgcgcttagccgacgatctgccaatgatgatcgagaaatcctatttgccagtgaagctatttatgacactatctcgggaactgctatcgataaaaccgttatacgatttgttttctgaagatttcaatcaaacggtacgatcggctgacgaagaattttatgccagtattgcccagaaagaagatagtgagctgctaaatattccagaaggatcaccagtgctccatttagttcgctcaacctataatctcgagaacgaagtgattgaatttacattaagtgtggcacgggccgataagtttcattataagatcaggcatctgcgttccactaactgaattggaggaaagaaaatgtttatgttgtcaaaagaagaactgcaaaagctaggagcagaaaatactacccgagaaattcgacaacaaccggaactgtggcatgagacgtttgaccgttatcaagaaacagtcgcagatctagatcgtttgtttacggatgcgaaacaacatgctggagagcgaccgatccgcgtcatttttacaggggccggaacctctcaatatgtgggggatacactaattccgtttcttactagtcaaggaaatacgaatcagttcatttttcaaagtattggttcgaccgatatcgttgctacgccaaaagaatacctgattcctgatgagacaacgatcttggtctcatttgcccgcagtggaaatagtccagaaagtctagccgcagttaagatggccaatcagctggtcaacaagatctatcatatcgtgatcacctgtgcaccagacggattattggctacacaaatgcctacaaaaaaagaaaatctagttttactaatgccaaacaaagccaatgacgctggttttgctatgacaagcagtttcagctgtatgacgctgactgcgctacttatttttgatcaagcaagcaatcagcaaaaagaaagatatgttcatcaattaagccgactaggagaagaagtcatccaacgagaatcagagatccaagggtatctggcatcagactttcatcgcatcatttacttaggttcgggaagcttaggcggattgactagagaagcgcaattgaaagttctcgagttgactgctggaaaaatcgcaaccgtttttgatacatctttaggattcagacatggtcccaaatcttttgtcaatgatcaaacattggttttcctgtttgtcagcaatgactcatatacgcagaaatacgatgtagatatgctggacgaaatcaaaaatgacggtattgcccaacgcgttgttggaattggtcaaaagggttcattgtttagtggtgattcctttgaattagctgcagattcgttactgccggatggctatcttgctttagcagatatcatggtagcccaaacgatcgcattactttgttcggtgaaggttggtaatacaccagatacaccatcgccaagtggaacagtcaatcgtgtggtcaaaggtgtaacgatttatccatatgaaaattaggaaagagtgtgaagcatgttagaatggtccgaaaataaaagacaagcaatggaacgtttatcgacgccggagggcattattaccgccctggcgattgatcagcgtggtgcactgaagaaaatgatgtcagctttagggatggaagcgacgaaagaaacgattgagcggtttaaaaccctgatttcacaagaattgacgacctatgcctcagccattttattggatccagaatatgggttgcctgctgcacaaaaacgtgcagcagagagcggtcttttgctagcatatgagaaaaccggttacgatcaaaccgttcctggtcgctttcctgatttgcttccggattgttcagttattcggtttaaagaatcaggtgctgatgcggtgaaatttttgctgtattacgattgcgatgaagaagaggaaatcaattttcacaagcaagtttttgttgaacgaattggaagcgaatgcatggctgaaggactgccattttatttagagttattgtcatatgatgctaaaaatgtagacacgaaatcgctttcctatgccaaagcaaagccgcgcaaagtgatcgaaatgatgaaagaattctcgaaaacccagtataaagtagatgtcttaaaggttgaagtaccagtaaacatgtcatttgttgaaggggatgcaacaggggagatcgcctatacacgtcaagaagctgccgcttattttaaagaacaaagcgacgcaacagatttgccatatatcttcttaagtgctggggtctcagcggcattattcatggaaacattgcgttttgccaaagatgctggggcacgattcaacggtgtactctgtggcagagcaacttggaaagatgcagtcgctccttttgttgaaaaaggagaagcggcaactttagaatggctgacagaacaagggacacaaaacattcgtcaattgaatgaagtgataagagaaactgccgtttcgtggcatgagaaagtagtacagccagtccaatagagcaattcaccttgcaaagctgactactaatgaatgggagcagaacatggctacgtttgaaataaaagaagagtttttaatgaatggttctccttttaaactactatctggtgcgattcattattttcgggtccatccggatgattgggagcactctctttataatttgaaagcgcttggatttaataccgtcgaaacctatgtgccttggaatttgcacgaaccgcataaagggttatttcagtttgaaggcattcttgatttagagcgttttttgtccttggcacaagagcttggtctgtatgtcatcctgcgaccttctccatatatatgcgccgaatgggaattcggcgggttacctgcttggctactaaaggagtctggacgattaagagcatgtgatccgagctatttagcgcatgtggcggaatactacgatgtattacttccaaaaatcattccctaccagttgagtcatggagggaacattctaatgatccaagtggaaaacgaatatgggtcatatggtgaagaaaaagcttatttgagagctatcaaagaaatgctgataaaccgtggcattgatatgcctttatttacttcggatggtccttggcaagccgccttacgagctggcagcttgattgaagatgatgtattggtcacagggaattttggttcccgggcaaaagaaaactttgcagcgatgcaggatttttttgatcagcacaacaaaaaatggcctttgatgtgtatggaattctgggatggctggttcaatcgctggaatgaaccaattattcggagagacccagatgatctcgctgaatcagtcaaagaagctttggaaatcggtagtgtcaatttatatatgtttcacgggggaactaattttggatttatgaatggttgttcggctagaggcgcagtcgatttaccgcaggtcacttcctatgactacgatgcaccattggatgagcaagggaatccgacagcaaagtattacgcattgcagaaaatgctaaaagaacattttccagaatatgaacagcacgaaccgcgcagcaaaacatctctatcaatggaacttcaactacaagataaagtcagtttgttttctgttatcgatcaaatcagtcagccggtcaagacggtttatccgcaaacgatggaacaattggaccatccttatggctatttgttgtaccgcacgaagaaacggcgggacgcggaaacagaaaagctccggatcattgatggaaatgatcgtgcccagattttcttgaatgaaacattccttgcaacgcaatatcaaggagaaattggtgaagacttattgattaagcaagcagcagaagaaaatcaattggatattctagtagaaaatatgggacgagtcaactatggacataagctgacagcagagacccagcgaaaagggattcgtagaggtgtgatggctgatctgcactttgtgaccaactggactcattactggctagacttcagtaagtcaccagcaattgattttacgcgggactggcatccagaacaacccgggttttatcgttattcctttgtgctagaggaaaaaagagatacttttattgatttgacaggattcggcaaaggagttgttctggtcaacaatgtcactgttggacgcttttgggaagtgggccccattttatcattgtacgtaccaagcggatttttgaatcatggggaaaacacaatcattatttttgaaacggagggctgctttgcaaaagaagtacatttgagaaaagaaccggtttataaaacgatggaggcgaaaaaagtatgagtattattggtgtacgtattgatggacgattgattcatggacaagtggcaaacttatggacgaccaagctgaatattagccgaattatggttgtggacgacgatgtagcagaaaatccaatcgaaaagagtggcttgaaattagcaacgcctgcaggggtcaagttaagtatcttgccgattgagaaagcagctgccaatattttggctggaagatatgattctcaacggttgttgattgttgctaaaaaacctgaccgtttgctcaaactagtggaattaggtgtgccgatcactgaaataaatgttggaaacatgtcccaaacagctgaaacaaagtctattaccaagtcaatcaatgttgttcccgcagatattgctgatttcaaagaacttgctagcaaaggtgtgaaactttttgcacaaatggtccctagcgataaagctgaaaactttatgagccttttagaaagataggagaatcaatatggaaattcattggtggcaaattttattattatcattatatgcaggttatcagattctagatgaattacagatctattcttcaatgagtgcgcccgtttttgctggtcttttttcagggttagtgatgggagatatcacaaccggtttattgattggtggtagtatgcaactgacagtccttggtgtaggaacttttggcggtgcttcgcggatcgacgccaattcgggaacggttttggccacggcattctctgttgcattaggaatggatccagaacaggcaattgctgcaattgctgtaccggtagctagtttgatgattcaattagatattttagctcgttttgcgaatacgtattttgctcatagaatcgatacccacgtggaaaatatgaatttcaaagccatcgaacgaaactttttgttgggcgcagcaccgtgggcgctatcacgacttgttcctgtatttctcgcgttggctttcggtggcggattagtcgaaaacgttgttagttatttgaatggtgatttaaagtggttaggcgatggattatccgttgccggagcagtcttaccagctgtaggttttgcaattttacttcgttatttaccagtaaaaaaacattttccttatcttattttaggctttgttttgacagcattattaacaacggtatttagcaatatccaactattgggcagcagtgtagcaagtgttgtaaaagatttcagcggtaccttcaacgcattaccaatgttggcaatcgcactaattggtttcgcatttgccgctatcagctacaaaaatggacaagcacgtccagcaactaataccgcacaaaacgagcagcattcggaaggagagattgaagacgatgaaatctaatgttaaattaacgaaaaaagacttccaacaaatcaatcggcgcagcctatttggtttccaactaggatggaactatgaacggatgcaaggctcaggttacttgtacaccattttgccgcaactacgtaaaatctatggggacaacacccctgaattaaaagaaatgatgaaaacgcatacacagttttttaatacatcaaatttcttcaataccattatcacggggattgatctagcgatcgaagaaaaagagggatttcaggcaaaagataccatttcagggttgaaagccgggttgatgggacctttcgcagcaatcggtgattcgattttcgcagccctagtgccaacgatttttggtgcattggctgcgaatatggccatcaatggaaatccgatcggcatctttatctggatcgctgcacaaatcgtagtcatgatctttcgttggaaacaactggaatttgcttataaagaaggtatttcccttgtgacaaccatgcaaagccgcttaacagcattaacagatgcagcgacattactgggtgtttttatggtaggagcattagtggcaacaatggtcaatgtaaaatttgcttgggcaccaagtattggtgaggtcacattgaatatgcaaaacaatattgatatgattttgccgcggctcttaccagcagctattgtcgggattgtctattggatgttaggaaagaaaaacatgacatcaaccaaagcaattttcgtcgtattgatcgtcagtgtggcactgtcggcgttaggagttatttcgaagtagatggaaagtaggtaggaagttgatggaaaagcaattagtcttgattagtcatggccggttttgtgaagaattgaaaaaaagtacagaaatgatcatggggcctcagtcagagatccagacagtcccattattaccagaagaaggtgccgatgattttcgccaaaaactagcagctgtcatcgctgacagtcaaaaccctgtggtctttgctgatctgctaggaggaaccccatgcaatgcggcttctcggttaatcatggaaggtgcgacatttgagctgtatgcaggaatgaatatgccgatggtgattggcttcctcaaccgtacattgacaggagatccattggattatgaacaatttggtaaagagaatatccaacatgtcaacacgcttctcactgcagtagcagattttgaagaagattaagcagaggcaaagacattagaagttgatcagcaaagaaaaaccggcattagctgtacttcttagctatcacctatttgccttaaccaaacgacaaaaagcgctgaaaagccccaactctttgaacaattccctaaaaaaaggtatgatagctaaaagtatatttttgaagggacatcaaagggatgaagtactcaacgaaatacagcgatgccattcatattctggcctatattgaaatgttgaagggaaccgatctatccagtgatcgaattgctcaaagtgtcgagaccaatccagcctatgtccgccgaatcatgagtgatttgcgaacagctggcttgattgagagccaacggggaaaagctgaacctaaattactaaaaaaacccgaagagatcactttgctagacatttattcaagtgttgaaaaggaccaacgattgttgcatattgacaaaaaaaccaatcctaattgtttgattggcggtagcattcaggaagttctagatgagacctatgagcgtctgcaaaaaaaaattgagttagagatgcaacagatcacactagcagatatcatagataaactcaatgtggctgctgaaaaatgaagagagacagctccgtttcaaaagcaaatgcttgacgaaaaggagctttctttttataatcaacatgtaaccttaaaagttacatgtatttttctacatgtacaagtttaaagatgaaaggaagagagcaatgaaaattggaattattggtgcaacaggaaatgctggttcagcgatttatcgggaagcaagtgcacgaggacatgaagtcgtagctatcgtacgcaatgaagaaaaagcaaaggaaatgtttgggaattctgtcaaaacaataaccaaagacgcgtttgaattgaaaagaggcgagttggaaggttttgatgctatcattgatgcgtttgctactagccctgatcaagcctatctacatgtcgacttagcagcccgtttgatccatcttttccgtggaaagaaaactagattgttcttcattttaggggcgggtagtttactgaatgatgctggcgacttgaatgttaatgacttgaaaaaagcacctgatagtgaaagctggatcgcgattccagaaaatcaattagacgagtacaatttcttattaactgttaaaaatgttgattgggtaggaatttctccagggaaccttttccaagctggggaagctaaaccggctattttaggaaaagatcacttgcttcaaaatgatgccggacaatctgtcacatctagcggaacattggcaaaagctattttggatgagttagaagtccctcaatatcaacaaacaagatttacagttattgatgcctgatttttttgacgatcgggatggtcttgaggagcaaaggagcggaaagaacagtaatgttttcataatgtttcttccaagaaaacaggaaagaaaccattttagaagaaagagttttcgaaattcaagaattctaccaagacaaaactctgcgagttgcttataatcaatagcagaggtgatggatatggagaaaaaagaagcatacgagctgatgctccttcagttaaaaggattgttagaagcggagagtaactggttagcgaatctggctaattcttccgcattgctgaatgaaacgttaccagatacggtctttgccggctattatctgtttcaagaaggcgaattgattctaggtcctttccaaggccgcgtgtcttgtacccgcatccagttaggaaaaggggtctgcggggagtccgctgctgagaaaaagactatgatcgtcgataatgtcaaagaacatgagaactacatatcttgtgactcggcagcaatgtcagaaatcgttgtgccaatgctggacaatgaccaactgatcggagtattagatatcgatagttcgaaaacaagtagttatgacgagatcgatcaacttttcttagaaaaatttgccgcttcgctagtagctgcacggcgtaattgataaaacgagcagcgaatcgtgttcgctggtacaaaagaaatacccaaacgatagaaagcgcaactttagttcttgaagttgctgaattgccggcttgtttctgaggcaacttctattcgtttggtttttttgtctgtactggttttttgtgcgaatcaatgcgtattacttttaattattaaaaaacgatgatattatgataacataattagaaaaattaaatttgaaggtggaaattatgaattgtgataacattgttttaggaaaagcgtatgaatgtaaaccggtaggtatgcaaaggaggatcatcggtgaggtaatccgcaaaatggaaaattgtgtggtgatgagtgtcgtaagatatgatggcattgatcatgacgaaatcgaggaacgatgtggaagagtcgttgctcggtataatgaaatctatggaccagctttagtcgaatgtttttttagttaaaaaaagacagaagcttattgtttaaaaacaggaaaataatgagctcaacaattaaaaataacaatttaatcaataatatttacggtgttagccaaattttttcagcaaagagtatcctttgctgtctgggacagtaactttcaagggcagaatacttgcctaatagttacggatcctattttctgctatcatcgttttttgtatgctgcgatagactgccaggcggccaataaatttcaataaagacttaatgatggtacaataaattaaaatcgtacgcctggaggagaatgttatgagagctgaattagtgatcttagaagaagaggagttactgtttaagcttcccaatgaacaaggtttattacaaattgcagatcatgatcgtgtgacacagcttgataatactgtgttttttcttgttaagaatcatgcggtaacagctattacaacggatacattgctggacttgactcagccccatgatcgaatcattagtattactcctagctgggaaatccaggcaccttaccttgcacattattatcaggagaagtatggtttgttgaagaaaaaaagtgaagcgatcccaggtgagcaaagtgagctcattgcatcttgcgcaaaaaattttgacttattgttagataaacttggctattaccaaaataccacttcccttgatccagtgaaaaaaacaaaagcaaggcatcaatggaaaaaagaattgcaggatcgacctttctatattgactatcaaggaagtcaggcaactgtttattggcaaaagcgcaatgaaatgcgaatcgaaaaaggggcaaaattagccgaagaaattccatataataaagacggttccttgggattttctgctcgcttaggagaaaaaatccgccaagatcatcaagcagcgattaaggatcattgcacgatagaagaagttattttaaaaagtgtcaatgaggttggtctgtttctttactacggagggaccaatggttggttgcagttaaaagacccatccgggcagacactccacgaactaaccgtggtgggctgacacgacaaatacgcgatacgcagtcgaaggacaacgcttgtcagatgaaatggattctcatcggcaagcgctgcccttcttttttagctgaactttcttgaaataagtttcaactcagttcttgctggaagatacaattgagtcgtcgaataaggaataatcttgtccactcttgtttattactacggaaggttttccgtttccttctttttctgcacgataagcttcacggtgtttttgcaagtgttcgggccgctttagccaggcttggaaatgtttcttttcttgccattttgagacgagttgaaaatcgactgatgcttttttttcgttgatccaacattcagattggagacagccttcaaacgttttcatcgaggcgatatctttgcggatcttttctgaaaatgtttcttttgcttctgctaaaacttcaaatgtcacagttttgatatacatgaccaacactcctttttgtggtaaatgcacgatttgactttgcatcatcattttccaattagtataactgtaattgagaatgattgtcaattaggtcggtatttttcttagaaaatacttgcttagtgaaaaaagatgtttctttcctacctaagaacagctaggaaagatctctccataggacctttctctaggtatcttagaagattctttcaagtaagggaatttgacagaaagattcgaatcacggtaaacttcacttaacaaaacggaatttttagaattatctgaaaaataggaggcgtcaagaatgacaaccaaagcaagagttatcggatcactcatcgtttgtagtttttttctagcagcctgtcaacagccgtcatcgaaaaccacagattcaaccaagtcagcaaatgccaatcagccaatgctgaatgttcagttttctgctgaaatggggagcgccgatttgtcgttagcaaccgattcttacagttttattaccttgaacaatgcctatgaaggactttatcgactcgatgaaaacaatgaacccgtgattgccggtgcgagtgaagacgcaatgatcagtgaagatgggatggtgtacacgatcaaattaagagaagatgccaaatggtccaatggggaacctgtcacagcagaggattatgtctttagctggcaacgaacggttgatcctgctaccgcctccaactatgcctacatgctagcaccagtcaaaaatgctgcagctatttccgatggaacgaaggataaaagtgaactagggatcgaagccgtcacgagtcatgaattgaagattacattggaaaaagcaacgccttattttaaatctttactcgcttttcctacttttttcccgcagagtgaagcggttgttcaagaacatggggatcaatatgccttaacaagtgcgaatgcagtctacaatggtcctttcacattggaggattatgacggcccaggtacagatattcaatggacactcaagaaaaatcctgagtattgggatgcagagtcagtgaagttatccggagttcagtttgatgtcgtcaaagaatcttcaactagctataatttgtatgaaagcgggcaagcagatgacatcacattgagtggggaactggcgatgcaaaatgtaaatcacaaggattatgttgttcaaccgagcgcgacgacccagtatttagaaatgaatcaagcagcggaggactcaccgtttcggaatgaaaagttgcggcaagcaatttcctatagccttaatcgtcagcaaatcgttgatcagattttaggtaatgggtcacttccagctgttggatttgttccttctgatctagcctttaatcctgaaacgaaaacagattttgttaaagatgcagggacttcgctgccttatgatgaagaacaagccaagaaattgtgggagcaagcaaaatccgaactaggaaaagataccctcacctttgaattactcacctcagataccgatcaatcaaagaaattagccgaatacattcaaggaacgcttcaacaaacccttgaaggattgactgtagaagtgaccaatgttcctttttctgtgcgattagatcgttccaatagcggagatttcgaaatggtcatgaacaattggatcggtgattatgcagatccgatcaatttcttggaacttttcaaaaaagatagttcatacaatcgcggaaaatggttggatgatacctatgataacttgatttcagaagcatccgatgcatatgccaacgatcctcaagcacgttggcaaaatatggtggaagctgagcagattttgaatgaaaaattgggcgtgattccattatttcaaagcgcagaggctcatttacgttccccaaaaatcaaaggcttagtggtccatagtgtcggtgcagcctatgactacaagaatgtttccctagagtaaagaaacaagcagtaagttagaagagatggatctttcatctttccccagattgcacaagcaaaaatgatcaataaatcagcaaaggagaacctagtgaaaaaagcagtccaagcagctatgacttttttatggaaacagccgcagcaaaatgcagttttaacaaaaatcaatgcgcaacctttagaagcagtccattcgtttttatcagcagcagatgcaatgactctctatgaagaggacttggttgattcagagattctttatgggaccgttgtcgaagtcgttcaagaaaaagaagaatgggcagaaatcattgtcttagaccaagcaagtaataaaaatccccgaggctacccagggtatgttcctagcaacgtattgactgtcatagacgagaaatatggattggggaaaaatcagaaggtagcagtaatcaaaccaactgctgtcctgcaattcaaagatcatcaaagaatcctttctttcggaaccctgctggattggctttttgaggacgctgagtggtatcatgtgatgacacctgaaggaccagctgaaatttctaaaacacaagcccaacgaatcgatcaaggaaactcaacaactccccgacaattgatcgagatggcagaacaatttctggatttgccttatgtatgggcagggatcagcagcagtggctttgactgctcagggtttatgtatagtttgcatcgggtcaatggtattttgattcctcgggataccattgaacaagcgcaagcgggtgtgcagcgatcctatgaacaggcgcagccaggtgatctattgttgttcgcatatgaagagggaaaaggaaaagtccatcacgtcggtctttatttaggtgcagacgagatgatccactcacagaccccaggctccaaagtcatgaaaacaaagatcactggttctgcttatgagccggaattggcagttgtcactcggtatatcgactagaaacagccgcaataagaaagaatgaggtagaaatcgcaagtgatagaaacaaaaaaatagcagtaaccgaggaaagcccaccatttttgcagaatgcagcaagaaatgtcgggctttttgaccgatcaaaagagagatcagttattagcgacaataaagtcacccatatcgtatcgatgccgggattgtgaaaattcaaaaggtatcccattttctaagtaaaccgtttgctcgacttctaaaatggggtcattgggggaacaaatcaaatgctgctggtcatagatatctggacggtcggctttgatccttcgaatcgatgtgccaatcggtaagtgcaatgtattggaaatatattcataaacggaagctttgagaacctcttcggtgatgccgggaatcactgcgactggcataatggtatattccagcgcgaccgggacgtcatccaataatcgcaaacgaacaatatcatagattcgatcttctttaccaagtctcaattttgtttgttcttgctcatcagccaaaagcgtatcaaaggaaatgattctgcttgtgagtttgccagtctttcctaagcgcttggttaatccgcggttcactcgggcgttataatcgaaggtagaataggcttcactgacaaaagtgccagtgccttttttggcatagatgattccctctacttgcaacaaattcaacgccttttgaatggttactcggctagttttatacgtaatggctaattcagtttgtttaggcagcttctgattcttctcatactttccatgactgatttgtgtacgaatatctgctgcaatatcatgatagtaagccaaatcatttcctccttttttgaagcataatcgattttgctgagtatgtaaacctcgacgtttacatactcagctttttgcttctttcgacgatttacagaatgaaaaaaatccagtaaattgagattgtaatcggttgcatttggtttgtttattttggttaatcatagaggagctaggaggagtaaaaatggaagggtttatggatcgattggcaaatggcttaggtaaagttgctacgagaatcaatagttggcggtacatcatggtaattaagaacgcttttgccgctttgataccagtcattatcacaggtgcctttgggaccttattttcagcaatggtttttgattcggagaacggcttagcaaaaattgatgcgctcagctttttagaaaatctaaagccgatctcttcggcagtcagttatgtaacacttagttttctaacgatttatgctgtttttttaattgggatcgaactggcaaaactgaacaaaatcgatggtgttttccctgggatcattgcagtgatgtcttacttatcggtcaatccgatggtttttgaattcttacatgaagatgctactgttattgccgagaatgttttagcgaaacaatatacagatacgaaaggtttattcttgggcatgttcgtggcaatcctatcaattgaactttatgcctggctttgccgccaaaaaagattgcaaatcaagatgccggaaagtgttcctgccaatgtctcagcaagtttctcggcgcttttccctacaatattagcagtaacgatcatcgcgacagttggctttgctatcaaagccatcacaggaatgtatgcttacgatatcatttataatattgtgcaaaaaccattagaagggatagtacaaggtctgcctggtatcttgttgttgatgtttattgcacaagttttctgggtcattggtatccacggcaatcagatggtcaaaccaattcgtgaaccattactgctagcggctatcgccgtgaatacagaagcctttgaggcaggaaaagaagtgcctaacatcattacgatgccattctgggatatgtatatgagtatgggaggatcaggtgtcaccattggcttgctgattgctatcttgattgcaggcaagcgtgaagatatgcgtcaaatcacgaagctgtccttagcaccaggcattttcaatatcaatgaacctgttattttcggtatgccgatcatgctgaacccgatcttggcgattccatttattctgaccccgattattaccggcacggtgggttatattgctacatccatcggttttgcagcaaaagcggttgtgatggtaccgtggccaatgccgccaatcgtcaatgcctacttagctacagcaggagacatcggtgcagtggtcacacaaatcatctgtattttattatcgatcattatttatttgccattcgttatcgtaatgaatcgttcaacgaacgaagtggcataaaaaggagaggcttatgttaattgaaataccagaaacatttatcttaggggccgcttcttctgcttggcagacagaaggctggcaaggaaaaaaagcgggtcaggattctttcttggatcaatggtatcaacaagagcgttttgtctggcatgaaggctatggaccagccgttgcaacgaacttcatggaacagtatggtgaagacattgagctgatgaaagagattcatctgacacattatcgcacatccatcaattgggcacgcttttttaccgactatgagaagttgatcgtcgatgaagaatatgcagcccatatcgatgcggtgatcaatgcattgcttgctgcaggagtagaacccatgttgtgtctggaacactatgaattgcctgcctacttattagacacgtatgatggctggagttctcggtatgttgtcgaattgtatagcaagtatgcagcaattgcctttgaacgttatggtgatcgggtcaagcactggttcactttcaatgaacctatcgtgatccagacccgttgctatcttgatgcgattcgctggccccatgaacaaaatacgaagaaatggatgcaatggaattatcataaaacattagcttctgcattagcgataaaaacatatcatgaaaaaggctatcaaggcagaatcggctgcgtattgaatcctgaaatggtgtatgctcgttcttcttcgaaagaagatcagcaagcgaaaaaaatgtacgatcttttcttcaaccgagtcttttttgatccgatgattaaaggcatttatcccgaagaactgattgcattatgtaaagagcatgatatttattttgatcctgcaaaagaagacttagaagtgatccaacaacatacggttgattttttaggaatcaatcaatactatccaaagcgtgtgcgggcaccttattatcagtggaatgctgaaacaccgtttcatccggagcgattctatgagaactttgatcttcccggcaaacaaatgaatcgttctagagggtgggaaatctatccgaaagtcatgtatgacatggcaaactacctcaaagaaaattacggcaacattccttggcttatcacagaaaatggcatgggtcgggagaatgaagaggcgttcatggatgagaatggtcaggtagtagatgactatcggatccaattcatttcccaacatctttattggcttttaaaagcagtagaagaaggggcgaattgcgaggggtatatgctctgggcttttaccgactgtatctcaccgatgaatgcctttaaaaaccgttatgggctggtgcggatcgaaagaaatgctgcccgtacccgttctttgaaaaaatcagcctattggtatcgagaattaattgatgaacgtcgcttgtcctatgaggaattaccgcttattctttaaactaagtacattaagattagagaagctgtgacaaatcttttgtcacagctccttgtgtatattgcttaaaaatccaattgatgaggggctaatttgtcccagtcaaaggtcacaccaattcccggttcttctggcgcgatagccattccatcctctggatcaatcatcagagggcgagtggtgtattgatcgatcgggaaactatgcatctctaggtatccggcattaggcatggcagccagcagactgacatgaagctcttgcatgccgtgagtcgagatactgacattatgcaactgtgtcaatgccgcaattttcagccagccagtgatccctccacaattcgaggcatccggttgaggaaaatcgacttgaccataagataacatatgagcaaattcaattggtgttcgtaaattttctccgccagcaactgctatttgaccttctttagcgattcgagcatatccttcgtagtcttcgggaatcgttggctcttccaaaaagagaatatcaaaaggcgccatcaatttagcggctttgacggcttgttcaacggaccagctcatattggcatccaccataaaggtaatatcgggaccgatcaatttacgaacggctttgatgcgggcgatatcttccgccaatgttgcttgccctaacttgattttgacagcccgtaatcccatatccaaatatttttgattgttggctaataatttttctaatggaaaattcaagtcaatggcaccgccatagcagtttactttattgctgtgtcctcccaaaagtttatataatggttctcgtgctttttttgcgcgcagatcccaaatggcaatatcacaggcggcaatggcaaagcttgctagaccacctcgggcaatgtaatggatgccccaattcatctgttcccaaagagcttccacacaagcaggatcttttcctagcaggatatgtttcagttctttgtcgatcaatttagcgatcgactctcctccgaaaccacccgtatacgtataaccgataccttctctaccatcatccgtgcgcactttgacgattggcacctcaaagtgagtgtgtaatccgtgtttggcatcttccattaattctggtaagggaatccgatagtaggaagtttggatttctgtgatcgtggacataaaattcctccttttccaataatgttaacgtgtgcattattatcttaacatccacttggcaagaattcaagcggtttcatttgtagtttgagttgtcaatctctttctatcattgtaataatcctgtttttccagcgacctttaaccaagtgattccgatctgaaaaggagtcaaatttcttggtgggaacacgctgaaatagttgaacttctgcgcaacccaagctatgatgaacaaaaaggagatcacacatatgtgtacaagtttcacgctgactgctcatggacagactttttttgctcggacgatggactttgcatttttgttagacggcgaaccaatcgtcatgccacgggggtatcaatggtctttacaactagggggacaggtcaccaatacctatggctttgttggaacgggcaaacagttagaagaatttctttttattgatggggtcaatgagaagggactaacgattgctgaactctacttttcgaatgaagctgtttattgcgaatacacagcggagaaaataaaccttgcaccccatgaattgttacattgggtattaggaaacgtagcagacatccctgatttgtaccaaaaaatcagcaggatcaatctagtacagatagaaacggcgctactaggtatcacagtcccattgcattttattgtaacggatactaccggaagatgtgttgtcattgaaaccaatcgtggttttatcgaaataaaagaaaatccaatcggcgtgatgactaacagtccagaattggagtggcatgtaaaaaatattggcaactatttagctgcgagacctgctaattttcctcccgcaacagtcaatggagtagaggtgctcccctttggtcttggaaatggaacatctattttaccgggcggattgacttcccctgaacgatttgttcgaaccgtttatcacaaacagtttgtgaatgtaggagagactgccgaagaaacagtcaatgccatgttccatctcttaaataatgccacgatccccaaaggactgatggtcgaagataatggtcaatctgagtatactcagtatcgagtggtctataatgtgacaaatggtacttactatttcaatccttatgaaacccaagaagttttttcattggaattgaagaaagagtggttacaattgaaacagccccggatttttgcggttgccaagagtttcacaacaaaaacgatggtgtaataatcggccacacaacggtcgatgcaaagatagataagtagaaaataacttagtttaacgaagagtcatctctccaataaaaagatccgcggtgtgtcattaccgcagatctttttttcgtgtgatttgccgtcgaaatttttgtagtaggtagctggggagtttatctattctgatgctgaaaaaaacggttcaaaggaaaagcgtattcttatgataatcgttcattgaaactacgagaagaaaacaagaaataatttttttactttcagatattaaaaaaaatctttgaaatacaataagtccagtaatttttttttatttgaaaatagtaaggcgtcattgataacaacactgggaacgtttgtttcagaaatcggctgattcgtgatgatcaaatcaaaggattccaagtcatagttacctaattgctcaccattgatgggcaggatatctgaacgaattttatgcagatcaagaatatcttgaacatagtaactgatgtattgactgtgattgatccccatatcgctgatcactaagatcttttttgacaccaaagtctgattgatctccggaaaagaagtcaataaccagaatacataagaagacaaataactgatgagattcgtttccaacaattcagaaaaaaaatgcagttctgctttgagtcgtgcatacaattggcgctgtgtaaatttgatatgtcttgtaaaaaaagtggcacgctgtgtcagctctgtcgtatcaaagggcagtaattgcgcataggaataaagacaagtcagcaagtgtacaacgaagtcgccgacctcgtctgtgatttgttccaactgcagaaaagtattgaaggtcaaattgtcacgtatcttctcactgatcacagatctattctctgaataaaattgctggaaagcccctttttgaaagtagtcaatgactgtttggcaagactctaaactaataccactcaaatggcgtttaatcaatgaatagtcttcattactgatttttgctttcacggctatcttggtgatagggcgttgccgaaatccttgactctctcttaacaaatcaacgataaaatacataatgaaaaagtcatgttcatagctgttgtccaagctgatactattcaaaatgcagtgattgcgccgcatcacttgttttagttcttgtttatcaaagtgataaggcaaatcacaatggccataatacatcaaaaaaaagtaggtcgtaaatatccgcagagacagctcatcgtcctgactcgttaactgatacccgcgatccacaatgacccgaagtgaataggcagccaacactttattgcaatgttttagttttcgtgcaaaagatgatcgactgatattgattgcctcacaataataatcgatcgttttgcctggctgttgaataaattcatgaaggagttgtgtcgttgttgaagttctcgccatatctgtgagtatttgaagatacaatgtagcattgaaattctctagacgataccctaatttatgcgatgttttgatggttaaaacatttccccagcgttgcttgatctcttcaatatatcggataaacgttgattcgctgctaccaatgtgtcttgcaagttcttttttagtcatccacttatcagaaatggataacacacgaatgatttcttccatcttccgataatttttctccaaaaacctaatcatttcatttcctcccaagtcctttactttaataaaacaatcaacgaaacaataacgcaatctcaataatgaaaccgcttggtatgaaagctggtgtgatttgattcttcccttctatgtatacttaggtatctgattagaataacaaatttccagcatgcaagctattgggatttgctattggttcgcaaatgaaaggggagaatgaaaattaatatactgaggaagttgtgggttttaggagcagtatttatgctggttagctcctatttcacatccataatcgttagagcagaaactattaatggggcagctattctatctgccaaaatcatatcagatgattctgagcagccacagctattactagatgtcgcactcacgaatcaaacaaatgagcccataaaaaaagaaataagaatggatcatgccaagctaaaagaagtagaagaaaaacaagagggatacggttatcaaattaaacacaataccctctatctgacaatagagcctcaactaaatcagaccattcaactgacgctgctcgttgagaaaaattcttttttgaccgagcaagcaccagaattaatttacgaaggtcagatccaaaaggtctctgttgtcatgccgcaggcaacaaaggaaaaaccgactgacacccaggacaatacttctagagcagaaacggatgctgtaaaggaaacagctgctacagatacacattcagcagaatccgaagagtcaaaatcaataaatccatcaaataccaacgaaacgctgacagaaaacagagaaacagaaggacctgaagcatctgaagcatctgaaagatcaacagctgcagatgaagtgataaaacctttttcactccctagcgttgcttctgatccagtgttcgatcgcagtcataaagcaatcctgcctcagtatacgacagatgcgtcaggaacctatccgacagcaagctggcaaccgactgggaatcagaatgtgcgcaaccatcaaggaaacaaagacggagctgcacaatgggatgggcaaacggaatggaacggggaaccaacgaacaaaaccaattcctatattgaatatggtgggactggttcccaagcagactatgccattcgcaagtatgccaaagagaccacgacacctggattatttgatgtatacctaaatattcgcggaaatgtccaaaaggagatcgcaccgttagatttggttttagtagttgactggtcaggtagtatgaatgacaacaatcgaattggcgaggtccaaaaaggggtggatcgatttgtagatacgctagcagaaagtggaatcacagacaacattcatatgggctatgttgggtattcaagtgatggatacaagaatgattcggtcgcgatgggcccctttgattcggtcaaaaatgccattaagacgattactccaagcagtactactgggggaaccttcacgcaaaaagccctgcgagatgccggaaacatgttggcaacaccaaatggacacaaaaaagtgattgttctactgacagatggtgttcccactttttcctaccaagtcagcaaagttcaaacagaaacgaatggcagctattacggcacccaatttaccaatagacaagaccagccgggcagtacttctcgtatttctaacagctactatgctccagaccaaagaaataccaataaattgatcaacagtacgtttatcgcaaccattggtgaagcaatggcattaaagcagcgaggaattgaaattcatggattaggcattcaactgcaaagtgatactaatgcgggattatccaaacaagaagtagaaaacaagatgcggcaaatggtgtctgcggatgagaatggtgatctttactatgaatcagccgatcatgcaccggatatttctgattatctcgcgagaaaagcggttcagatatctggaactgtggcaaacggcaaagtaaccgatccgattgctgaaccgtttagttacgaaccaaatacattaacagtcaaaagtgtcgggtcccttcaagtacaagccatgcccacactctcatttgaagggaacaccgttcgtagtgatgaaatttatttagggaaagatcaagaaattcagatccattatcaagtcaggatccagacagaatcagcaacgttcaaacctgatttctggtacccgatgaatggcagaacaaccttccaacgagtagcaacagcagatgaagtggtagattttggcgtgccatcggggaaagcaccaggagtcaagcttgatttcaaaaaaatctgggaagaatatgatcatgatccgagcagccgcccagaaaatgttatctatgaagtgaccagaaaacaagtttcagatacgacaaattggcaaacaggctacatcaagatttcgcaaccgtcaaatgataccggaagcttatgggaacgcactagtgtaacacagctttcaaagtcagcagatgatgcctatgccgaaaccttaggtctacccaaatacaataatcggggacaagatttcagctatcaaacgactcgagagctaactgtccccggttatgagcaagaaaaagtagatgaaacaacgtggaaaaacacgaaacagtttcagccattagcacttaaagtgatcaaaaactcttctgctggcgaaaaaaatctggtaggtgctgtgtttgaattaactggcaaaaatggccgtacgacattgatcgataatcaagatggcagctactccttgccgcaaaatgtccgactgcaaaaaggtgaaacctatactctcacagaagtgcaagctcctgctggacatgaacgtgggaaaacaacttggcaaatcgaagtcacttcagagggaattgtgacaatcgatggggatgaggtttctacagaagaacaagtgatcacactgaccgtggttaatctattttcagaattgccaatcggcattcgcaagtatacgctgcaagacggaaatgaagtaaatttatctggggcaacattttcgttgcaaaagaaaaattcttcagaccgttatcaaacgatcgctacggaaaaaacaacggattcaggggtagcccattttatattagatcagccaggtcaataccgaatggtcgaagattcaggtccattggggtatgacacgatcgccggcaactatgaatttacggtggataaatatggaaagattcactacgacggcaaaaatgtggataaacaaagtaaagaatggacgttgaatcatcaaaaccagttaaaagcctttgacttgaccgtccacaaaaaggccgacgatcagacgccattaaaagggacggaattccgtttgatgggtccaaatacagacattgaacgatcaggagaagagacggatacgtttgtctttgatcagttacagccgggaaaatatgtcttgacggaaacatatacgccagaagggtatcaaggattgaaagagccaattgaaattgtgatcaatgaagatggctcagtacagattgatggcgaagaagtcgctgatgtgttagttgctggagaaaaaaacaaccagattacactagatgtgaccaatcaggcgaaagttccactgccggaaacaggtggaagtggtcgattagggatttatctactcgcctttagttcgatcgccatcgctggtatctacttatacctccagcgattagaaaggagggggtagcggatgaaaagcatgcgttggtttagtgtatgcatttttctagttgtgttactaggtttctcccaacaagtttcagcaggagaaatgcaagcgaatgttcgcatcacgttacacaaggtactatttcttgaagggcaattaccccaggaacaaatcaattccggagaaggtacattgcttcaagcttaccgcggtttaaatgatgtcacctatcacgtatacgatgtcaccgattctttctatcaattacgggaagatggtgaatcggtggaagctgcgcaaagaaagttggctgagcaaggtcctgcagccggatccctgattgccgaaggaaagaccgagaagatccaaggagaagatggtttacttagcttcacattagcagccaaggacagccagcagcgggataaggtctatttattcgtggaagcagaggctcctaatgtcgtgaaagagaaagccggaaacttggtcgttgttttgccagttcttgatcagaaagggaatcaaatgaccacgattcatttgtacccaaaaaatgaagagaaggcatacgatttgccgcctcttgaaaaagaagtgcagtccaaaacctctgattttacctatggcgagagagtgggttatcagctgtcaacacatatcccagaaaatatcttggattaccaacaattccaactatcggatacagcagattctgccttatttctcttaccagaaacgatcacagtaaaagtaggaacatccgttatgacaggatatacacttcaaataacggatcatggctttgtcctggatttctctattcagcagctagaaaaatttgccaatcaaaaattgcaagtctcttaccaaatgaaagtaatgaatgcagagcctgacacagagatcgtaaatgaagggcaattgctgacagataaacataccatcaacaaaaaagttgacatacggactggtgggaaacggttcgtcaaaagagatagtcaagatccgcagcgaacattggcaaatgccgtattcgtcgtaaaaaatcaaacgggagcctatttgcatgaatcagcccatggttatcaatggcaaagagaaaaagcgggagctaaacgattcacttctgatcaagccggagaattttccgtcaaagggttaaaagatggtcactatttcttggaagaaatccaagccccaaaaaattacttgcttaatcaaaaagccattccgtttgtggttgaaaaaaattcctatacaacaaatggaaaagcagctaccccactggcaatcatcaacaagaaacatactggttttttaccaaagactaatgagcaacaagcaacaggattgatcttagccggtgtagcattgataggttttgtcattgctgggctgattgaccaaaaacaaaaacgaggagaaagaaaatgaaacaagcaaaaaaagtatggtacttactaagtacgctattactaacattacctatttttatcaatgggttgggtacagcagcttatgctgaggaaaatgcaagcaatgcccaaatcgtcattcataaaaagaaaatgaccgatcttccggatccgctcattcaaaatagtgggaaagagatgagtgattttgatcaatatcaaggtcttgcagatgtcactttccgcatttataatgtgacgtcagaattttatgcgcaacgagtagccggggcaactgtcgaagctgcaaaacaagcagttcaaggtctaaccccaggttcgccaatagctgaaggtataacagatgcagatggcaatattaccgtaaatgtaccgaaaaaacaaaacgacaaagatgctgtctacgtcatcaaagaagaaccaaaatctggggtagcggctgctgccaatatggtcattgccttcccggtttatgagatgatcaagcaatcagacggctcgtataactatgggacagaagaattatctacggttcatgtttaccccaaaaatatcgtttcaaatgatggggcattacatgtgaaaaaaagaggtactgctgaaaatgaatcgttgaatggtgcagaattcgtactctcaaaaaatgaaggttccccaagtacgaccaagtatattcaaggggtaaaagatggtctccacacttggacaaccgacaaaggacaagcaaagcattttgttactggtaaaagctatggaatcggcgaagatgattttacagaatctgaagagaaaactggtgaactaacggtgaagaatcttgaagtgggttcctatacgcttgaagaggtcaaagcaccgaacaatgctgaattgattgatgatcaaacaaagacacccttcactattgaagcggataatcaaaccccagtagaaaaaaccgttaaaaatgatacatcaaacgttgaaaaaacaacgcctaatttaaacggcaaagatgtagcgattggtgaaaagatcaagtacgagattgcggtcaatattccattaggtattgctgataaagaaggaaatgccaataaatacaacaaatttaacttagtagatacccatgatgatgcattgacctttgacaatacaccttcaggagatacagcctatgctctttatgatggtgatacactgatcgcatctgaaaactatcaagtaactgaacagacaaacggcttcaccgtcgctgtcgatccagcgttcatcccttctttaacaccaggaggtacattaaaatttatttacttcatgcatctaaatgaaaaagcagatccaacgaaaggctttaaaaacgaagccaatgttgataatggtcataccaatgaccaaacgccaccaacagtagaagtcgtcaccggtgggaaacgatttatcaaagtcgatggggatgtttcatccacgcaagctctagcaggtgcctctttcgttgtacgtgatcaaaatagtgagggtgcaaactatttgaaggtcgatgaagcagcgaaaacagtgacttgggtggcaaacaaagcagatgcaacaacattcacgacgcaagctgatggtttagtcgtcattactggactaaaatatggttcctattatttggaagaaactgcagcgccagaaaattatgtattactaacaaatcgaatccaatttacagtggatgagcattcttacggaaccacagaagaattagttgctcctgaaaaagtgcctaacaaacacaaaggaacattgccttctacaggcggaaaaggcatctatctttatttaggcagcggtacgctgatcttgatcattgtgggtttgtatttcatgaaacgaaaagaaactcgttgattttctgttttgctagattttcacttctagaaaaattggcagcctcaaaagcagatctcagctatttcgacctagtcagataaaaacgggaggttgcaacagacgtggtccgcttcaagaaataagaaaggattttcaaaaatagcttttcccatttttttgaaaagctatttttgaagaagctgattctaaccgcttgttgaaccacttgttcggaaaacggagctgtgacaagtcttttgtcacagctcctttaatttttttgaggaggaaatgatgaaacaaaaaagaggacaccagatagtcgatcgattgatgatccttttgttgttgattggtgtagggattttttcctatccattcattagcgatgcactgaataattatttggaccaacagatcattgcgcattaccaaacagaagcaaatcaagaaaatgccgccgcaatggcgaagttgcaagcgcagatcgacaaaaatcaacagctagccaaagaaggcggctcccccggactggatccattctctgaagcagagaaaatcagtaaaaaaccagataaatcgtattttgaaagccatacgatcggtgtgttaacgattcccaaaatcaatgtacgagtccctatttttgacaagaccaattcagcattgttggaaaaaggcagctcattactggaagggacttcttttcctacaggaggcaaaaacacccacgccgtcatttcgggtcatcgtggattgccgcaagcaaaactatttactgatttgccagaattgcaggaaggcgatgagttttatttagaagtctacggcgaaacactcgtttatcaagtcgatcaaatcaaaactgttgtccccaccgatacacaagaccttcagattgaatctggtaaagatcttgtcacattgttgacctgcactccctacatgatcaatagtcatcgattattggtaagaggacaccggattccttatcatccgaaagtcactgatgacataaagaaagtcaaacagcaacaacagcagtttctgtggatcctcatttttactgcctgcggcttcctcgttttttgtatttggtggtataagcggcgaaagaaaaaaactgggaaccctccagtatctagcagataaaatgagttggctgatcaaagaaaccctgtttttaataaaaaatttttttgatttacagggcataaagaaagctgatttatttgctagccagcacaatctttgtatctcttatgctatcgaacctcccgtaagatgttaagaggattgacaaaatattcgcaaacgctataatgagggtgtattagtggacaaggacgtctgctaatccttttgaaaactagctatcaaagaagatacaataaacgtatacttatgaagtgtcagggaaagaggtgtgaatcctctacagacctacctactgtatggtggatgaaaccaatagaaccacagaatgattctattctggaaggattgggagtaagaagaagctaagtcaggataccggcttgataagtctattcattcttttgtaggaaaaagaaggggcttcgacgataactggcttgatctactgttagtactgttaatgaaccactttttctattaaaggaaaagtggtttttttgttttttgatacaaagtaaaaggagggatagacaaaccgtaggaaagaagaataatcgatttatccgtaagggttggaagaaaaaattcaaaaaaagttgaatgcgaggaaaaaaagatgaaaaaaattctaatgacgatcatgaccatcggagtagttgctgggattggattagcgggttgcggcaaacaagaaaacgaagctacggcttcaactgagaaaacagaacaaaatttgccgacgaaagaccgtagtgggaaagagatctcattgcctaaagaggcaactaaatcgtttcactggttccatcagtaacagaagttattgatgatataggaaaaacgaatgaattggttgctgttgacatgcaaagcgggtcactgaatgaagcgcttcaggcattacctcaaatggatatgatggcgattgatgcagaaaaattgattgcattgaaaccgcaaatcgtctatgtgaatgacattaatttagcaagttctgaaagtgtctggcagcaagtagaagatgccgggatcacgattgtcaatataccgacaagtaccagtattcaagccatcactagcgtaacaacaagtactcagaaaagagccgatagttgtcctattcggacctcctcgatcaaaacaaagtcactatcacgaaagatagaatatgaaatacagcacttgaagcatcttctttattttcctatgttgagagatgacacgtttcctgcagaactatggctgtactttgagaaacaacaagcttggttggagaatatcattcaaggaaaattctcggtgattgaacaagcgattgatcaagagcaagtagtgatagagagcagtcagagaagacaatgggattattcttcaaaggaaatccaacttcaattgaacaaaatcctattcttgttcgaagaaaagcctgataggcgctatcagtatttccaagaatgggcggatgcgttgatccaaacaatgactgtagtaaaactgaactaggagatgaacacattggattcaatcaatgaaattgttgaagaagttatcaaacgaattcaactacaaaatcacacatttgaagtagaagattctggacgtcacgtccatttgtctcgtcgagaaatcgatcatttatttggatcagggtatcagttaacgaaagtaaaagatttgtcacaacctggtcaatatgtatgtaaagaacgaatcactgttgcaggaccaaaaggactgttccaaaatgtcgtgaatttaggtcctgaacgtaaggaagcacaagtcgaagtgtcaatgacagatacccgaattttaggtattaacgcgcctgttagagaaagtggaaagattgaaggaacaccaggggtgacattgatgaatggcgcaacgactgtttcattagatcgcggattgatcgtggcaaaacgacacatccatatgacaccagaagatgccctagcaaacaatgtgactaacggacaaatcgtccaagtaaaagtactaggcacgcgaccattgatttttgatgatgtagtgatacgtgtcagtcctcatttcgcgacgtatatgcatattgattatgatgaagcaaacgcttgtggtttatcaaaaggtgttcatggttacatcattaagtaagagaaggttggacaatgaaagcttctgaaatagaagaactggttcaacaaattactgatcgtatctgtcagcaactcccaaagcctacccttgctcttgctttttcgcaagagaaaaaagagattcctgccgaattatatacccagtttcccattgttcagtggagaaccggtgaagatcaagagtcggctggaatgattgtgaaacaactaacgatttctcaaatgtccagtattgctttactgcaagaaaacgatctattgacccgaagaatactttcatttttgttacaaggaaaaccaattcttgttttagaaactttgccagcaattccgaaagaaacaccgcttaaatatcaagtgaaaaagacaattcaagaatatcgagacaaatgtcagcagtttggtctgacattctatcgctccccgcaagactatgctgatttttggaaatcctgtcagaaaaaatcagtgcctaaggcattgcctaagcggaccttcatcaccgaaaaacaattgaaaaaaatgctagaataccgcattcctccaataaagaatgcgcaattgacaccattagcacaagattatgcgcgcactcaaaagttgcttataaagggggaaaaagcatgcttttaggaaaagttaccggcagtttgtggtctacaagaaaagacgagaaattaaacgggtggaaatttatgatggtagacattttgaatcaagaagaacaaaaacaaggctttattattgcagcggataatgctggcgcaggaattggcgataaagtattgatcagtcaaggcaatgctgctcgaatttctgctgaaaatccagaagtacctattgacgcaatgatcgttggcgtcatcgatgctgcagaggaagaataaggaggttgaatctatgagcattaatgaaattattatgtatattatggttctttttatgatcattggaggcattgataaatgcatcgggaataaattaggacttggaaaacaatttgaagaaggtatcatggtgatggggtctttagcgttatcaatggtagggatcatcacgttagccccggtcttggcgaatcttttaagtcctatcgttgttcccgtctatgaattgctgggtgctgatccggcaatgttcgcgacaacactactagcaaatgatatggggggatttgctctggcacagcaattagcaaatgatcctcaagcagggttatttgctggagcaatccttggggctatgatgggaccaacaattgttttcaccattcctgttgcgttggggattattcaaaaagaagatcaacagtttttagccacaggggtgttaagtggaattattaccattcctttcgggttattggccggtggtttaaccgcaggaatgccaatgtctatgatccttcctaacttgctacctatcattatcgttgctgcattgatcatcgtgggattatggttggcaccaaacggtatgatcaaaggattccagatttttggtcaaggtgttgtcatcgttgcgattatcggtttgattgtcggagcgattcagttacttgtgggaattacagtcattcctgacattgcacctgttacagaaggaatcgaagtcgtagggagcatcgcattgactttagctggggcattttgtttggttgctgtgattacgaaagtgtttaacaaaccgttaatgaaattagggaaagttttagggatgaatgaagtggctgctgccggtatggtggcaacattagcaaataatatcccaatgttccaaatgttgaaagatatggataacagaggaaaaatcatcaacattgctttcgctgtttctgcatcttttgttttaggcgatcatctaggctttacggccggggtagcaaaagaaatgatttttcctatgatcatcggtaaattagtcggtgggataactgctatttttgtagcgatttttatggctaatcgtatgttagggaaaccagaaatagaaacaaaataatgaggtgaaaatatgacagagtttaatcgtaaaatgatcgaaactttggttcgtcaaatcgtaactgaacaattgatgccaacaaaacaagtggatcctagcggtgttgcatcgatcaagctaccagagatcactgtttctgaagaagatcgtttggatacagggaaccccaatgatattgtttatacaaaggatttgttctcactcgaagagagtcctcgtctaggttgtggattgatggtaatgaaagaaacaacatttgactggacgctcgattatgatgaaatcgactatgttatttctggcaaattagatattattattgatggacggaaagtctctgccagtgcaggtgagctcattttaattcctaaaaatagcaaaatacagttttcagtcgcagaagaagcccgctttgtttatgtcactttcccggcagattggcagaatcaataaatttgttgaaaacaagacactatatattttcttaagttgatacgctacatcaggtgttccttttatttatagggacgccttttttttaaaagaccctttagttaattaatatacgtttggaagaaaagatgttttttacaaagcatacgtgccgatctgtaggataaaaacgaagttctatgtaagtagacaggacaaaacaaaaaacaattgaatgagtaactcgtatctattgttcgaaatagttgcaaaaatggtttatttcaaatatctttaaggagcaacatgcattaatcatagaagagtattaggacaaaaggcttggggaagactttttgtagacacctaatactcttcgtttttgtattttatcatgatatcagctagtttgtattaaatggacgaaatttcgtccaccatgttttgataggatcctcccatggtgaattctggcgtgatcgtacaactcaatgtttgttttgttcaggctgatacgtatcttcgatcagtgtgtggtcaagcttttcagtctaaattcaattgcttcatcgtaatcatttatgacaagagcaatattttgtttcacgattactcttcctttatagcgatgcaagtatcattctgagctaaagccaattattcgccacaatagcggactaatggaaatctaaaaaattatcactaaataagccaaataattttatttaacgagggatgtcagccttaaaataatagcgaaatcactaaaaatcggcgggatatagttaaaaataaaatggagaaaaacttgcctgctttacgctcgatctcatatcttcgatcatttctatcagttaaaactcggttagaaatcgagcccaaaatagtccgttagtaattttaagtaaaaaagcaaatagtaataagaaaagggttcccctaataaaagatacgatcactccctcacaatctgatgagtaagagcaaatgcttgctctgaaaagtttgttttatcgctatctgtactattaacctttagtgaatcatttaacttgaaaatatttaaggatgatcgtaagatagttttatcaaatatataaggagtgttatctatggcaaactatgaagaaaaagaatcaaaagcattgttaaaaatcggagaagttttggacaagttagattctaatttagcagaattggattctctagaagcagatgctaaaaaacatagtatgaagaagtggattgttgagaaaaaagcgattcatgaaatcaagaagatcgcacacgaagcaggtaaatacgaaacgtatgatgagaaagaattacaaaaagagttggacgaagtagaaaaatatatgtaaggaagagacgttttcttttcgtttttttctcttattttagttaaaataaatttccagcacactaaggataaatttgcttgatcaaagggaagcccgcttgcttgttttgtgagtaaggaggcttctttgcttatacaagcgactaaaagaatgcatctgtcgcgatgctggtcggcttgactgttaactgataatctcagagaaggcaggttaaaaataaaaaagaagcaagataaacctcatagaaacaaggttcatctcactttggaaaaactacgaaaatcttctcgattttagtctatggagatggcgggagtcgaacccgcgtccaaacatattgctacctaaaaatctacgctcatagtcagctcatttaaggattcgctttacagcttgccgagtgacaggcagtctgtattgctagtctgatgttctcttttttaacttgcagacggaaagttaaaacgtatcccacttagaataggacccttactcgagcacatgggcgatgccgagaggatctacgctaactgtttttaggcagctaaagcgtaagagttttcgtttttagcagttatatttaactgtaacgttttaacgtagacgtaacctacgaagcgcaattcaggctcaactatgcctgtcgaatccgtaacatccccctgataaaaggggtatcgctaccaatcattagtataacataatttgcgctatatgcaaagatttagatcaattcaaaatgattcaaggcatgcacgatgccgccttcagtatttttaagagtaacaaaatcagcaatctcttttagttctggcaagccattacccatggcaattttatagtcgcaagcttctaaaagagcgaagtcattgctaccgtcaccaaagccaaatgttggcacatctttgagatttagtaagttcaccaatgtcttaattcccgttcctttagaggtgccgcttttcacgacatcaattgaaaaaggtgtattgcggtagaaagtcaattcagggaactgttctttatagactgtttcattggcgatacctaatacgagcatcatattgatccggtctttttcataacggaatggatcgatttctggaagggggctgcggacataattgtaagcctcgatcatctcatcattgtgtccagttgcccagtaaccattctcgttataatatgaaagttcgtcgccatgatctctcacggcttccaacatccgtgcgcagagatttttatctaatgtgtctgaaaacacttctttgccatcgatacgaatgaatgccccattcatgacaatatttgaggtgatcccagcagcctcgcgaatagcaagaacttctgtttccgttctgccggttgcaatgattggtaaaacatcattttggcgtaagcgatgcatggcttcagaaatttcgggggtgatctgggagtgttcatctagtagtgtgccatctaaatcaaaaaatgctaaagctttataattcatacagttttctcctactcttattgacagttacaaaatcaatcttaacaaagattgctaaaaacgcaaacctttatgaagaaaccgtgaagttgttggtagataggaggttttcgagtatactagagaaagaatggagtgggaatatgatttttttagtgattggagcgattttctttttgatcggttttgtttttttgattctcccttcaaagaaaatcaattttatctacggctatcgttcttatttagcaaaacagaatgaacgaaattggcagtatgcacaaaagatctgtacgcggtattttctgctgtttgggggagtcatgacattgataggaatcctactgaagtggcagggatggaccaatttctttctcttagaaatgattgcaattccttggtttattgtaccgatttttggtttgatcgaagaaaagctgcaacaatttgatgaacaacataggggtgaagacaatgaatattctaatgattgaagacaatgaatctgtttcagaaatgatgcaaatgttttttttgaatgaaggttgggatgcgactttcaaatatgatggcaaagagggactggaagcttttgccgaaactccagaaaaatgggatatgatcacgctggatttaaatttgcctaccatggatggaatgatcgttgccagagagattcgcaagatttctaatacagtgcccattattatgctgactgcccgtgattcagaaagtgatcaagtgattgggctggaaatgggcgcggatgattatgtgacgaaaccatttagtccattaacattgattgctcgtatcaaagccctgcatcgacggagtgaaattgctgagaaggcaagttctgagacttcagacacgacatttgatatcgttaccgatcactttaaaatgaataccaagactcgggaggcttatttgaacggcaaattgatcgatggtctgacgcccaaagaatttgatttgctttatacattagcgaaaaaaccgcgacaagtcttttcccgggaacaattactagagttggtttgggattatcaatattttggtgacgagcgtaccgtcgatgcgcatatcaaaaagttgcggcaaaaaattgaaaaagtgggaccgcaagtgattcagactgtttggggagttggctacaaatttgatgatgcaggtgctgcctaatgcggtatctttatcaacaattgattgcgttttttgctgtgattctagtcattttgatgacgattggagtagcgtttacccaaatgaccagacagacgttgcaagagcgcaattacgagcaattgatggggtatgcctcttccgtagcaaaaatttcccagatcagtgactcagaattttttcagcagaacatgacgcgagatgaatatttgcagtattcactacatcttgctgaaaatattctgagcaatcaagatatttcttttgctttttttaaaagtccgaaagaacaaatctatccattagatacgtcgggacgagcggtcgactttagcatttcagaatcagattggcagtcattgcaaaatggtggtcgattacaaatgacttcgaataccaatttattcggcgaacgagagttgacttcctatgtgttgattcctttttctgttaatcggacggatttttatggcgtgatggtggtttcacaatctgccagcaatattttgaatctagtcagtgcttttaatcagaacttattcaaagtcttcttgatttcgatcattgtttcgctattgatcagttatctattcgcgactttccaagttcggcggatcaatcggatgaagcgggcaaccaaagaaattacgaatgggaattttgacatctcattacctgttcataatcgcgatgaatttgatgaattggcagaagactttaaccaaatgtcccagtcattgaaagagtcgcatgaagaaattgagcgtcaggaagaacgacgacggcaatttatggctgatgcttcccatgaaatgcgtacgcctttaaccactatcaatgggttgctagaaggattagaataccatgcaattccagagaatcagcgagacaatgcgatccgcttgatgaaaaatgagaccaatcgtttgattcgtttagtgaatgaaaatctggattatgaaaaaatcagaaccaatcagatttctatggtcattaagaagtttgatgcgaccaagacaatgaccaatctgttgacgcaattggaaagcaaagcagaagtcgcaaacgatcgtttgattctggaaacagaggagtcgatcgacgtctatgccgactatgaccggtttgttcaaattatggttaacatactccaaaatgcgattcaattcacacaagatggtgagatccgcgtgcgaatcgaaaaaggctatctagaaacgatcattgagatttctgatacaggaatcggtatgtccgaagaacaagtcaaaaatatttgggatcgctactataaagttgatccttctcgaaaaaatcgacaatttggtgaatcgggattagggttatcgatagtggaacagttggttcgcctccacaaaggtaaaatcgaagtcgatagcgaattggggcaaggaacgaccttcaaagtgacttttcccgatatcgaaatagaagaataagctagaaacatacagtatgcttttttgcagtgatagacaaaaaggaaaccatcgtcatcgatggtttcctttttgtgtacctataaaatagaaaagtctcattgttttgtgatatagggggtatgagccaagcgttcatcttcattcattaaatagatcgatagctgaaattgttttgctagttgactgcataaaggcagaagggcttggatgtcggcggtatgtaaattttttgaaagagtctctaaaactatgaccggtttttccaataaaagtgccagtaacaattgtactttaacttcttctaaagaagtgagttcatctaaggatcttttcaaaaaagtcggttctaaatgaacggcagttaacagctcttccaaaggtttttcttttttattggctaaggaaagattatctttcaatgatagaaaggggacatactgccattttggctcgatggtaaccgcttggttagtttgcagaaagtgtgccaacgtctctttcgcagcaaggtcattggctgcaagatagaaaagacctgggatgtttagttgattttttggtttttccattgctgattcctccaataaaaacagtggctggtgacgacgactaacgtaatgattgagactgaaccaacgagtaggacaaaggtttggcgtaaactttttagaatcattgacaaccattcattgctgttcaattcaacattctgaatgaatgcttggcttgtttgtggaatcgtaatgccgaaatccgctgttgtttggctattgaccgactgccaaatctgcaaggaggcatcttctctgtcgaaagttgtgatatgactggtaatcatttctcgttgaaagaaaggctgaaatagaatcagcaatgcaaagacgaggacgatgattgcaagcagtggcaggaggacttccaagagctgcattcctgcccattgccgcgaggaagctccgctcatcagccatgcctgaaattcctttcttttcattcgttgataaaaaataatgaaacctgtgaaaaccaataggaaactgatgaaaatcaacagaaaaagattctgataaatagatgcaatcggttggatctcttgtgcgatttttgccggcatttcttcaccaatcaaataatctttggcttgcataaataattggttcaatgagtggagcagagtatcactaatgattaaaccaatcacggcaaaaaaggtcaacaatccatagaggatcaatgcttttttatgataatgaatgctggctacagcaaaacgaaaagttttcattcaattcacctcattctactatctagtataaaaggggagtttgaataaagtatgaagttcttgtacaaaaaaaagaaagtcagcggagacttcttgattttttgtgcaaaaaagtaccgcgagcgatcaaacgctagcggtacttttgattgaagcttatttatcggtctctttgaccatttcttcgtattctttataggtcttcgtatgatacaaatcgacggtcgatttctcaccattttttgagaagacactcgttgaatcggcaccgagttctttttctttggcactcagtttttgtaaggcatttttgtaatcatagttatctggatcgacttctttcaatccgcttttcgcatagaagcgcaacagatctccattattgatttgatcagagaccgacagttgcttatcgactttggctttccattcatccacttgcttttgtaagcttgctgaaggacttgggatcgccatgccagtactgttactgtaaaggacgcctccgtaataagtatactctggtgtaacaaagtcaccgtctctaaatgcaacgagctgttcgttttgtttcgagaacaaatcttgtcctaattggatatatttcgaagtatctacacctaacagatgaagtaaggttggtaaagcatccacttgaccaccgtacgtatgattgattccgcccttcgattgtccaggaatatggatcatgtaagggacacgctgtaaggctgcattatcaaaattagaccagctagcgctgtctttaccaagcaattctgctaagtttttgtttcgcgaatttgaaataccgtagtggtcaccgtataagacgatcacagaattatcatacagaccagattctttcaagtagttgaagaattcttcaactgctcgatccaagtagttggcagtagcaaagtacccgttgatcgtttcatcagaagttgttgctaacgggaagccaccttcatcattggtaaattcagagtatgggtagtgattagagacagcgataaatttggcgtaaaatggttgttgcaaccgttccaagtattgcgctgattgttcaaaaaatggtttgtcatgcaacccatattggaatgagttatcttcgttgacatcatagtaagaagcatcaaagaagtaatcatagccaaagcgtttgtaagtctcgtttcggttccagaaggtaccagtgtttccatgaaaaacagctgatgtgtagccttgtgtttgtcctaaaatatctggtgctgcttcaaaggtattcttcccgccaagttgcgtgaagagagccccttgattcaaaccaaagagtgaattctcaaaaagtgtttccgcgtcactggtttttccagctttgacttgatgaaagaaattatcaaagctaaatgtgcttttactatgatacaaacgattaatgaatggcatcacttcatgttctacgccattctcatcttttaatttataatcgatcagaaattgttgtgtactttctaaatggacataaatgacattttttcctttagcgatcccgaacatgtcgtcattaggttctgcataatgctgcttgacataactttcgacttcgttcatatcattgggactagcttctgctcgaacttgagaagcttgatacgtctgcacgccatcataaacagtaaatgcattgatccctaaatatttgaccaggtaatcacgagaaaaagttctagtcaataattctggacgatctgcttcggctaagaacaaatttcctgagaagatcattactgctaatgttgaaatggcaaaagccatccgagctttaacgggacgctgatccattttgattttcttcataacgagagcggcaatcaaaatgacgaagtccacgaagtacaataaatcgtaaggtctgaaaagacgaatcgcactttctcccagaccactagcaacttttccggcaccaagcatcgtattgatggtaatgaaatccgtgaactctcgataataactgacatttgagaacagtagcagtgtcatcaagaaatagatggcgatcatggtgatataggctgcttttgttcgtctcacatacagtgcgatcgaaagtaaaaataaagttgttgcgattggattgataaataagatgaagtattgcacagtgctttcaatcccaaggtggaagtccaccaaataagcaaagatattttttaaccaaaataatagggccaatatgaaaaaaaagcccattcttgtattcacaaaagtggatactctattttttttcaaaggaatcttcctctctctttccagcttaaacgaataagattcgaatttacatcatcctatattctactagtccatcgaaacagtgtcaatcgaattccctgtcgtggtgcggaattaagtatttctttactttcaagattacagacaaagaaacaggtttttgctatacttatcaatagaatgaatggagcagataaacgatgaaaatgaatttaagcaaaaaaggaatcaaaaaattccataaaaaaaacccattgatccaagaagatgatctcctgcaagtcaaagatacacaggattgggtctcttttgtcgattcgcaagggaaaattgtcggaaccggctatttagggaaacagaataaaggcatcggctgggtattggcttttgaagatcgtccgatcaacaaggacttttttgaagcagcttttgcaaaagccaaagccaaaagaagtgcttactatgccagcgaagaaacagatgcttttcgtatcgttaatggagaaggtgaccacttaggtggattaacgattgatctctatcgagaatttgccgtattttcttggtataacgaaacattgtaccaaaataaatctctattgatccaagcgttccaacaagtttttccagaagtcaaaggagcggttgaaaaaatccgctttgactctgatctgccagaatcagcagccgtctatggagaggaggcgcccgaaccgctgattgtgaaagaaaatggcgttcactatgctacctatcttaatgagggactgatgaccgggattttccttgatcaaaaggaagtacgcggacaactcgccgaagggctgtcagcaggcatgacagtgctcaatatgtttagttataccggtgctttttctgttgcagctgcgatgggcggtgcgacaaagacaacgagtgttgatcttgccaagcgcagtttggagaagaccaaagagcagtttgcaatcaatggctttgatccagaaaaacagaagattcatgtgatggatgtttttggctattttaagtatgctaagaaaaaagagctgacctttgatatgatcattttagatccgcctagttttgcccgcaacaagaaaaaagtcttttctgtcgcaaaaaattatggtgaactggttacggatagtttggcgattatgaacgaggaaggcttgttgattgcttccacgaatgctgccaacctttcccaaaagaagtttcaacaaatgatcgaagaagcaatggatcaggcacaagtcacatatcaatgtatacaagaatatcgactaccaagtgattttgcagttgatcctaactttttagaagggaattacttaaaagtattcttttaccaaatcaaaaaggagtgagacggatggttcaagtaaagtcaatcgagttggatggcaagcacccgcgcatttgtgtgccgctgaccggaacaactaatgaggagattatcaagcaagccctagccgcagaaacttcggatgcagagatcattgagtggcgggctgattattataaaaaagtcgatagtttatccgacgttctggatgtactttctcacgttcggaccactctaaaatcaaaagtttttctgtttacgtttcgaaccatcgaagaagggggacaaatctctttcactttgacacaatataaacatttatgtctaggcgttgcagaatctggattgatcgatatgattgatatagaactggaaaaagctgagtttttaggcagaaactttattcagaaaatcaaagaacatcaagtgaaattggtgttaagtagtcacgatttcgacaaaacaccagaagatgctgtgttgatcttaaaaatcgggattatgaatcaatttggcgctgatatcggaaaactagcaatgatgcctcacaatgtgcaggacgttttgcgtttgatgggcattatcaataaagcgcggggattcaatcaattacctttagcagtcatgtcaatgggaaatctaggcaaaatcagccgcgtcagtggtagtctgatcgattcagtcatgacttttgctgcgctggatcaagcttctgcccctggtcagattccagtggagcggatgaaagattatttagctgagttttcaatcgaaacaatgaaaaattaaacaatcgggaacataaacagaaaaaaatgggacagactagtcctatagtttcgagcagtcttaaatgagactcttaaaattgaagttgtaaagaaagaaccagaagtttggataaatgaggaatgcgtcatggcaaaagtaaaaaaaacaaatgcgattcggatggtagaacaaaagaaactctcctatcaggaatatacgtacgaatggtcagaagatcatttggatgcagggtctgttgctcagcaaatcgctcatccagaagccatctataaaacgctggtagcagttggcaataaaacgggtcccatcgtcgcagtcatccctggagatcacgaattagatttgaagaaaattgctaaagccagcggcaacaaaaaagtagaaatgttgcacttaagagacctagaagagaccacagggtatattcgcggtggatgttcaccgatcggcatgaagaaactctttccaacctatattgatgaaagtgcgcgacatttggaagaaatcatcatctcagcaggaaagcgtggtttacaaataggactgtctccaacagatttgagcaaattagtccgcggacagtttgtctcgctgactgctatttctgaagttggctaaacaggaacagacaaaacaacagagccgctgcattgaagtaggatacttcaatgcagcggctctgttgtttgttctatggacaattattccataacggaaatatcaaagacttcaatattatctaatccaccataaaattcataccatggggtagcatattcttttagaatagcattcagttcttcgacattttcccggccttgcgtatctaaccaatcaagcagtgctttttccccttgttttccatagatttccacgctgtctcgccaagttgcacgtccgccaagaataccagagaactttgccccgtgttcgccggcaaagcgtaattcttctcggaagatgtttgcaggaacccctgcacttaagtaaatgaaaggacgagtagcggcatcgctagcttctctaaagtagttggcagcttcttcttgggtatacacagcttctaagccttctttttgaaacccttcaaccaaatcaaattgtacgggtacttcaacttttaaaatatcgatatggtatttgtctttggtcaattcttgaatcgttcgaatgacttttccaggtttgattttagcgaaagccggtgatttatcatcggtgatttcatcgtcgtagacgattggttcgacaaaaattgggatatcggctgcttgtgcttccgtacctaaacgttctagaaaagcatgtttcgtatcaagaatctcttgcggttcatcaggattgtaataaaccagcactttagctgcgtcagctcctttttggactagacgttgcagagattcatttggcaacagctccggcaatcgtcctggagtattgacatcataaccggttttttcataagacagaatcaaaccagcattaggatttttcgcttcgatgccttgaaatccatattcttcatccaataaaatgctgctgacatactttgtcaattcttgtgaaaccaaccgtttgaagtcataaatttgttccattttgaaattatcgggccctgtggcagctttcatcatttttttcattgatcctcgctgatcaatggccaatgccgcaatcaccccatcttcatttgaaagtttctgcattttttcaaatttgcctcttgaaatacgtttcatttgtccagcctcctttaagttctctttcagtctacgccttctcacaaaaatcgccaactaataagcaatttctagaaatgcaaacaaaaaaacgaagctttgtcactaccccgcaagcaatgggatgtgacagcaactttactcagatgcaagtctgcgaaagattcgaaattccttgtatttcattgtgtcagatcgttaagagaataaagactatccttgtgaatagtggaaatagctcgccatttctgccgcatgcttgccagcgacatgaccagtacaaaaggcagcagtgatattgaatccaccggtataaccgttgatatcgagtaattcgccgccgaaataaaggccattgatgcacttactttccattgtcttgggattcacttcttttaaatgaatccctccacccgtcacaaaagatttttccagcggaaatgttttagaaattgtgacagaaaagcctttcatgatagctgctaaagcctgtagctggtcttcagttgtttgctcagccaccagatcagaaagtgccagtcgatggataaagaactctagcagacgttccggcaagatgccgctcagtgcattgactaattttttcttcgaatgggctgccactgttagctcattcaccaattcattcgctgttttttctggaaaacaatccagcatcactgtgacaggtgtatgactcttcaattcttgattgacaaaagaagagcagcgcagtgcagctggacccgaaagcccgaaatgcgtgaacaagagatccatggtatgagagacaacggtttttcctgtagaatctaaaacagataaagcaatatcttgtaaagagatgccttgcagtgtgcgttctttgataaatggctcctctgatatgaggggagactcggtaggataaagcggtgtgatggtatgccctacttttttggccattttgtagccgtctccagttgctccagtcgaagggtaagttcgaccaccagtcgtcaggatcacacagggcgcagtaaattcttcgaattctgttcgaacgccttggatctgagtctcatcatgaagtaatttagtgacgactgtattggtcaatagagtgacttgtttctcatggagcgcctgtaataagccttcaacgatcgttttcgatttgtctgtgacaggaaacatccgtccgtgatcttcttctttcagagggacaccatgggattcaaaaaaggtcatcacatcgaaattattgaattgcgagaatgtactatataaaaattttccgttgccgggaatatgggcgatcaaatcatcgacagagcgatgattggtcacgttacaacgaccgccgccggtcataagcaattttttgccaacttttttatttttttctataagtaatacgtctgcaccgttttcggctgctgaaatagcggccatcatgccactggtcccagcaccaatcacgatcacatcataggatttcttcatcttccttcacctctttgtggattgtaccatattgcaggaacaagcggggagaaagctgtttgttcaatgaatcgaaaaaaaattctgacaatttcgtaaaaaatagatgcaatttctgaaattttctataaaatagaatttaactaaaggaggtagtgcctgatgacaaatgcttcagagtatgtaaaagcgatccaagagaaactgcacgaaaaagatcagaaccaaacggaatttttacaagcgatagatgaatttttaccaacaatcattcctttcttagaaaaacatccagaatacattgaatcgaatttggttgatttattaacagaaccagagcgatttattcaatttcgtgtgccatggcaagatgaccaaggcaattggcaagtcaaccgcggttatcggatccaatttaattctgcattagggccttacaaaggcggcctgcgttttcatcccagcgtcaacttaagtatcttgaaatttttggcttttgagcagattttcaagaacagtttgactggattaccgattggtggcggcaaaggcggaagtgactttgatccaaaagggaaatcagatggagaagtcatgcgtttttgtcaaagtttcatgacggaattagcaaaacatatcggccctgacttagatgttcctgcgggggacattggtgttggtggccgtgaaattggctatctctttggggcttacaaacgtcttaaacaatatgatgctggtgtccttacaggaaaaccattggacttttggggaagtaaaaatcggacggaagctaccggttacggggcagtctattttgttaagcatctgttgaaagatttaaaggaaaacttccaagggaaacaggcaattgtatctggaagcggcaatgtagccatttatgcgattgaaaaattgcatgagttgggcgcaaaagccatcacttgctctgattcttctggcttcatttatgacaaagaaggtatcgatctggcattattgaaagaaatcaaagaagtgaaacgggaacgtttgacagcatatgccaacgcacgcacctcagcagagtaccatgaaggcgcttctgtctgggacttcgatgttcaagcggaattagcattcccttgtgcgactcaaaatgaaatcaatctagaacaagccaaacgggcaaaagcgaatggtgtccggattgtttctgaaggtgccaatatgccaagctctcttgaagcggcagaatattttattgcgcaaggaatctactattgtcctgggaaagcggctaatgcgggtggcgtagcggtttctgctttagaaatgagtcaaaactcacaacgtttgcagtgggagcaggcagaagtcgatcaaaaattggatgagatcatgaagaatatttatgatgcttgccgtgacactgcagaagaatttgatcaaaaaaataatttcatgctaggagcaaatgtggctggatttgaaaaagttgctaaagcaatgttttctcaaggacttgtctaactctgccagataggcgatataataaggaattacttgaaaaaagttcaaaaaaaacgtaaagtagtacttgtatgaaaaactaatttttttcaaggaggacaaatcatgtcacacatcaaatttgactattcaaaagtagcaccattcgtgaatgaatacgaattaagctacatgcaaagtcaagttacagcagcagataaactcttacgtgaaggtactggtgcaggtaacgactttttaggctggatcgacttgcctaaaaattatgataaagaagaatttgcacgaatcaaaaaagcagcagaaaaaatccaatcggactcagaagtattagttgttatcggtatcggtggttcttatttaggggcaaaagctgcgattgatttcttaaaccattcattctataacttgctttcatcagatgaacggaaagcaccacaaatcttttttgccggaaactcaatttcttcgacttatttagctgatttgatcgaaatcatcggtgatcgtgatttctctgtcaatgtcatttctaagtcaggaacgacgacagaacctgcgatcgcattccgtgtcttcaaagaacgcttgatcgaaaaatatggcaaagaagaagcaaacaaacgtatctatgcaacgacagataaagcaaaaggtgccgttaaagttgaagcagatgctgaaaattgggaaacattcgtaattcctgatgatgttggcggacgtttctctgtcttgacagctgtaggtctattgccaatcgctgctagcggtgcggatatcgatgctttgatgcaaggtgcagcagacgctagtgaagcatatgccagtgatgaccttgaaaaaaatgaagcgtatcaatatgcagcaatgcgtaacatcctttaccgcaaaggaaaagtaaccgaattgctgattaattatgaaccaggaatgcaatacttctctgaatggtggaaacaattatttggagaatcagaaggaaaagaccaaaagggaatttacccttcaagtgctaacttctcaactgatttgcattcattgggtcaatatatccaagaaggccgccgcaacatctttgaaactgttgttaaagttgaaaaaccacgtaaatcaatcacaattcctacgcaagaagctgaccttgatggacttggctacttacaaggaaaagaagttgattttgtaaataccaaagccttcgaaggaacgttattggctcacacagatggcgatgtaccaaacttattggttaagatcccaacgatggatgcctacacattaggttatacaatgtatttcttcgaaatcgctgtaggtatttctggttacttgaatggtgtgaatccatttgaccaacctggcgtggaagcttataagaaaaacatgttcgcattgcttggcaaaccaggctttgaagagcttgcaaaagaattgaacgaacgtctataatttatcgttctaactaaaaagaaccagtcctccgatcattcttctgagggctggtttttcatttatataagcggatggttcagaataaggacgcttattcatttaaccataaaatgaccgtcacaatagggcattaatttgtggtctttaggaacagttaaccaatcaaggagtcatcaacgattttcctttaaaccaatcaataatgcgactgtcaagagaccaaaaatacatgtttggattactggcattctgctcatctcctttcctttatgttactaggactttctggaagatgcacgaacacaccagtcataagaagcgaacgattttgtcatcttgtctgcggaaataagtaggtgccaaatttatcataaaagcgcttgcataaatcggtatttttgttattatatttttagaaaagaagttctgaggtggtaagatgctagatattgaaattggaaatgcctatgtgtgtcaacctattggggcaaaaaaaacgctagtcggtgtaattgagaagctgtatgagcatacggctcttgtgaaagtgaccgattatgagatggaggatcaatccattgtattggagtgcaatcagcggatgttggtaaaatttgataagattaccgcagtggctgtggcttaataaaaacaagactggaactcgctaataaaaatgtattatgtcagcatgccgaaaagtcagcttgtaggcactgattcatctttattgactagagtccagtctttctttttagctggcgtgaattagccgacgccgatcacaaagttcagtagcttatctgagtaagtcatttcatcggtggactcactgagggtttggttcaaaatatccatccgatcggtaatgatgccgtccacaccgtagaactgcatccgactgatctcggcatcatcatttggagtccagacaaagatatctttatgatccgttttggcagatgaaacaaagttgcggttgatcgtactatattccatcgttaaaaaatcagcacttgttaatggagggccaacgatgttgaagggcatgatatacccagcagttagttccggagcctcttgtttcaattcttccactacattataggtcaagctttgtagaatatgttcatgttcggctagattttcacggtagcgttcaaggaatgaatggactaatgttgtcgtatcttttcgttgtgtcttgatttctactagcaatttctgattcaacgaattcgctaaggataaatagtcatcaaatgtagcaatcggagccgtttgtccattttcagagacggttaatttttgtgcttgtgccaaagttgattgctccggtttctgattgaagccagtcaacgctttaaatgaaaaatcgtgataaacaatgaaatgaccatcgctagtttgttgaacatccatttcaacgtaatcaggatggtagttctcactagtgaagcgcagtgcttctaatgaattttgaacgccttgaccattgctgacgccgcgatgcgagatcgtcaatggtcgagtattagcggcagaggtcagataattcatgttgtataaacttactcctaccccgaagaagacggctactacagtaatcaaagaggcttttagtcgttgaaaatttcttgctggcaatggttcttcactgaaccattgtggtatctcaggtaagaaaccttcatcgtccataaaatcaacaatgatatagaagatggcaacggtagacaaaatgatattcaacaacaaaacgagttgaaggagcgtcataatgaagactgctgaatacagcgcatagtcagcgaaaagttcttcaatgatcgcttgcaggataatcaaaaaagtaaatcctactgttgaaatgaataagatcgcgccgccaataaagacaaattggccaacaatcgcaaagaaacggcgtttcgttgtctgcaaactttctcgaatggcctgtcgaaaaggaaggtcacgtaagatcatttctggtaaagcaaaaatcacacgaatccctagataaatcaaaagtaagtagccaagaaccacggctccgataatcaatacacgattcgtaaagatgaaatccatgataaaagcagggattttcactttagagagcaaatctgagttaaaacttagcccgccaattggcaaaatcaaaaagaaataaaacaagaaaaacaaaaaggtcatggggcgtaatttgcgaatttgtaaaaatgtcattcgcaacagctgtcgcaatcggaccggctgctttttcttgatgaaatagacactcagaagcaggaatgtaaactcaaaaaaaactgctaataaaatcaacaacaagattagagagagcgagaatagaaccattggatgctctgtaaaaatactacctatattgtcgaaagataaataggctaatcccccacgacgcaggataaattttgttgaagaagaaagcagtgggataaccaaaaaaagcaagaaaccatgcattagcagaacatctcgaaaataagcatcgcttgcctttagaaaatcccaagtgttgatcaaactattttttagatatttcatgttgttcatcctaactctagactataaaaaaccgaactatcgtgtttgattcctgtaatgaaaggaatgaccaccatctatagttcgggaatttcctgtatttatttttgctattaagcccggcacttagccgcctaatagccctgttaaaaacgtaccgccataaatcaatgccatactatataagaaaatcgataatggttttgccaataaaatgatcaaagtgaatttcttgactgaaatattcgttagtccagccattaaacacaaggcatcatccggggctaccggtaaaaagatagcaagtgcaaagagtttttcaaatcgactttggttatccaaccagccaatatatttatcatatgttttatcactgatcatactgaggataaatggtttaccatatcttctgccaagcaagaagatgatcactgaaccaatactaatgccaacataattgtagacaaatccaagatatggtccaaaaatcaagacgccagccgcactggatatcccaccaggaatgatcggaattacaacttgtaaaatttgtagcagcatgaagatgattggtcccaaaataacagagttgcctaccaaaccacgcagtgcattaatatctttaaagacacctagattaatgaagtaaatcgttaaggcaatagatagccctaatcctataattgatatcgtattaatgatacgacgagaagtggcgatactcacagactttcatctcctttattcgtttctaattccactatacgtggtgtaattagaaaaatccagcaaaataaatgacattcgtcaaacaaatttgtaagatttgatacccttattataaaagaagaatagcaagaaggcattgtactaaagtctgaaataagaaaaatttagcaattcatgtacaaattatcacgagtgatcgataggcaagttgttttcatccttagttattgctttcattttttatatttatttcctagttgtctcctctttatcaagtcgtgctcttcgtttgttttgccaacttgcgatggtcttttcaacgacactcgtcatcataaacccgcccgcgattgctcctgcagtgatcaaaacaatcatgaggttttctaatcccaaaaggttatctcccaaggcaaattcacgaacagctttataagccggaccaccggggaccaagggaactaaactaggaatattgaagatgatcatgggcattttcttgcgtcgtgaaaaaaagatgctgacacagccaaccgcaaaggcagcataaaaattggcactaccaatgccatgacccatttcatgcagctgccaataaatcatccatccaacagttccagcgatcccggttgcaatcaatgcacgtttcggtatatttgttaatatgccaaaggtgacggtacttaaaaaactaaaacagacatgaatcaaaatggtcatgataaccccccaaacaaggtgaagactgtagcgattcctacgccgattgcggctgcagtaaagatagcttcagttcctcgcgcagttccactgatcagatggccagctagaatatcacgaaatgaatttgtgatggccactccaggaactaacggcatcacggcaccaatgatcaggttgtcaacatttcccgccaagcccccgcgaacagataggatcgctaagcagccaatcactaaagaggcgacgaacatatccaaaaagcggatatcgatcgcttttttcacccagagacctgtaatgaacccgatgctgccaatgaaaaaagtaacaatgaaatcagaccaattgccgccaaaaataatcattaatgtactgctgaccactccagcactcaatacttgtaaccagagaggaaagcttggtgtgacttgattgatctctttaagagatgcatacaactgcggtaatgtgatctgtttttctgcgaacgaccgggaaagccgattgacggccactattttctccaaattgatcacacgatcatgaacattttcaacttgagcgtagtgactgcttcgtaatcccataaagatgcctgtagcggtcacataactgatactattggcttcgccagcgttagcagcgatacgattcatggtatcttcgactcgataaacttcggaaccattctccatcatgatttttcctgccaagaggcaagtttctaacaataactcatctgtttcttgcattttaacgcctctctatcttgaaaagtaatcctcctattagtttacctttttcattccaattcaacaagagaagtatccggtgagttaaataactaataataaagaaaatatcttatttttttaaagcaaccattttatttaaattggtaaaaaacttcacaaatagcggtgtggatataattgtagaacaattcagacagttataagataacgaaatgagtatattgtttttcaatttggaaaatctcggttacaattagataaaggaaaagggggatttattgatgcgaagaaaggtctatacaagagaacatattttgaaggccgcgtatgagttgatcaataaagaaggatttggcaactttaccgcccgaaatatagcaaagcaaatggggatttcaacacaaccgatttatttggaatttgaaaacatgcaggatttgaaaaacactttagttgaagcggtcttcaaagatctttcagaaaacgtgtttcctgttgaacggactggtgataaagtcattgatttaggattaaactacattcacttcgcacaagaaaaacacaacttgtatattgctcttttcgtagatgactatggcggagggaaattgatgcacgatttttcgtctgattatttcaaaaaattgatcaagtccgaaccaaagtatgcggatctatcggaagaagcgattacagccttgcacaatggtgcttggatcgttgttaccggcattgcttcattgatgtcagctggaatcattacgccaacggaggaacaaatcattaaggtgatcgaggaaacgatcactgggattttagatagaacagacatttttatttttcaataataacgaatctgcaaccattttttcggatggattgcagattttttcttgactttttctgaaaaaagtagaaaataaacgttatggagagttggcagagtggtaatgcagcggactcgaaatccgccgacccggttcatcccggcgcgcaggttcaaatcctgtactctccttacattaacgctttgaagcgtttggcctatccttggtgataggctttttttgttttgtaagtaaagacatggggaggaggggcccgaggtatgagaaaagcatcgtacacgactcataaaatttaattaatgagttgattcaggcagcagtgagagcttaggaaacgagttttgataatgtcatgccattgcttctttttttgaacgaaatcgattaaactagaagaaagagaacaagaaagcagaaggtgataaaatgtctgagtttgaaaaagattatgtcatgcgccaaacgaaattagctgttaagggactatccgtttttttgaaggatgaatcagtagatgagatcatgcagttggatgaacagcagagtggacaaaagaaagagccagaagaggaaaagcagttggagtagctgtttaatttcataacaaaacaagaaagcacctgctattagtcttagcgaggtgctttcagtacgaatcggtatccttcatttggatgaactccttatgcagttttagtcaattcttgtacagcttgttcgatcgtcacaccagttgcaaaacggttagcatcttttttatcaaaaacgataaaaaggttcagttttgtatctagagtaactcgatattgtagttctgtgttatagaatgtcatagtcattctcctttcagtgttattcgtaacgaaaggcaacggttaagttgataacgaaattccatgatcagaataacacgttgcttggcgtctgtccaataataactgaatggtagaggaagtttactaaaatttattaaggagaacagaagttatctaaaaaaatcaaataacaaatttgtaaggaagctcctttagtatctgagtaaaaagcggtatgaagcggttttgcttgaaaaactctttttgttgggttaaataattaatttattatatttttttaaatttaattttattcaatttatggtaagataagatttgtttcagggaaaataaaaaaggaaaatgaaaatggatgtgaaaatatgtgcggaattgtaggtttcgttaatactaaagaccaaaaagccgaaatcattgaacagatgatggatcgaatcattcatcgcggtcctaatagttctggaaaattcattgatgaccaagttgctcttggctttcggcgtttatcgattattgacttagaaggcggtacgcagcctatttataatgaagatggaacgaaagtaatcatttttaatggtgaaatctataactttcaatcgttaagagaagaattgatccaagctggacatgtctttacgactcatgcagatactgaggttcttcttcatgggtatgaagagtggggaactgatttattgcaaagagttcgcggcatgtttgcttttgccatttgggatcgcgaaaagcaagaactttttggggcaagagatcatttcggaatcaaaccttattattacgcggaaatgaatggtacattcatgtttggttcagaaatcaagagttttttaccacatccagattttgaaaaagaattgaataaggatgccttaaaaccctatttgacttttcaatattcgccactaaatggcgaaacattctttaaaggcgtttatcgcttacaagaaggtcactattttacttataaaaatggcgtcatggacattcatgaatattgggatgcagactacagtcataaagaaaactatagcaaagaagattgggtccaaaaaatcgatgataccgttcaagaatcgattgctgcacacaaaatcagtgatgtagaagtagggtcatttttatcaagcggtgtcgactcaagttatgttgccgctgttctgcgtccagatcattctttctcaattggattcgatgacaagacctataatgaagcaattgaagctagaaaattgaccaagatgctgggattgaacaatacagcagcggtgattgatggcgagatgtccttcaacgcttttccactgatccagtatcatttggatgagcccgactccaatccgagttgtgtcccgctctactttttagctaatctcgcctcgcaacatgttcgtgttgtacaatctggtgaaggcgcagatgaattatttgccggctatgctgcttatggttggcatacgaactccaagatgattcgtgtatttgctcaaggattgaaaaaattacctaagaatattcgattcaaattaggccggacaattggtaatatgagaaacttccatggacgaattcatctctatgaagccaccgcacctgcaaaagatttctttatcgggcaagcgctggtctttgaagagcaagaagccactgagatattgcatccagactatactagtggaccatcagtggcggaaatcgtcgccccatactatgaaaaagtcaaagatcttgatgaagaagtcaacaaaatgcagtatttggatgttcatcaatggatgcccaaagacatcttattaaaagcagataagatgtcaatggctagttctttggaattacgggtgccattacttgatattgaagtcatgaaagtagctcagacgattccgacaaaatatttgatcaatcagtacaatacgaaagatgtctttcgtcaagcagcaaatcgtcacctcccaacagaatgggccaatcgggaaaaattaggttttccggtccctattcgagcatggctgaaagaagggactggttacaaaaccgtcaaagaactatttacagcggattttgctgcagaattctttgaccaagaaaagattttgcaattattggctgatcatcgcgccggtaaacaaggacttcaacggaaaatctggacgatctacactttcttgacctggtataaagtattcttcattgatgaaaaaattcctaaggcagaaacaatcatttacgaaacaatttaaaaacacgaggacagatgtagtccctctaaagtccattttcatacagactttggagaggagagacatcgaatcctcgtgtttctttttgtctttttatagggctaataaattttccaagtagtcagctaagccgtcttcggcattggttttatccgttacatcattggcaatagattttaattgtgcggttccatttgccatagccacaccccagccggcatattccaacatttctagatcattgtgttcatcgccaaaggcaataatatttttgggatcaatcttcagataatcggaaatcactgatagacctaatgctttatggaccccttttggaacaatctccaaaattgcatgaggaccgccccatgtacggacatcaaccgtgtcattgaattgatcgttgattcgtagagcaacagactcagcgaattcattttgtgttttgaccaataatgaagtcggatcagatttcatgttcttcaataagttttcttcagtaatactatcggaagaaaagaaacgctgatcaaagccttcaagttgatcgataaaaaaggtttcccgattttctgcagcaacaaaatctaagttcaggttctctttttgagccattagttcaaaagcgatttcttttgacacagagaattctgtttcatttgcccatacttgacgaggtttgtgtaccaaacctccattaaaattgatcataggtgtttttagggctaattgacgataaaactgatcactcattcgaaaaggacgaccggttgcgatggtcacataatgtccagctttcgttgctcgtgtcaaaacatcaaatgtccgctttgaaatttgggactctgtatttaaagtagtgccgtctagatcgatggcaattagttttttgttcactcgactcgctccattctctttttctagttgtttaagtgtaacacattttactgatttcacaagagatgaaagggggatggtaagtttctggaaaaaatcagcttcttgataaaacacgaacgttcggataaaatatttggtttttgttaatttttttattgtagaatagggggaattcgcctataatttgtaattgttcgatggaaagtgcaattattcttttcttttcagaaacactaactaatcttgtaggagtgaacgatttacatggaaaagtttttcaaattaaaagaaaataaaacaactgtttcaacagaagtgatggctggggtaaccaccttctttgcaatgagctacattctttttgttaatccttcgattctttccgcatctggtatgccttttcaagcagtctttctggcaaccatcattgcctctgtcattggaacgctggtcatgggactctttgcaaacgtaccgtatgcgcaagcaccaggaatgggattgaatgccttctttacctttacagttgtctttgggttaggttattcttggcaacaagcattagctatggtctttatctgtggtgtgatcaatattttgatcacgatcactaaaattcgtaaattgattattcatgccattccagagagcatgcaacatgccatcggtggtgggattgggatcttcgttgcttacgttgggttgaaaaatgccaatctattaagtttcagcgcggatactgcagcagttactggatcaactgttgatggtgatacgattgttagtgcttcatttaatggaggcatcgtgccggcactcgctaactttaataatgcaccagttatcttggcaatcattggcttggttttaacaacgttattagtggttaaaaacgtccgaggagcaattattatcggtatcttagggacaacgatcattggtattttgatgggtgtggtcgatttaagcacgattgattggcaaggaaactctttgggaagttcaattaatgaacttggaacaacttttggcgctgcgtttggcccagagggaataggttcattgtttagtgattctgctaaaattcctcaagtgatcatgacgattattgcctttagtctttcagatacatttgatactatcggcacatttattggaacagggcgccgtactggaatcttttctcaaaaagacgaagaagcgttggaagatagtaaagggttcaatacaaagatggacaaagccctttttgccgatgcaattgcaacttcgatcggtgcgatctttggaacatctaataccactacttatgttgaatcagctgccgggatcggtgctgggggacgaacaggattgacttcagtggtagtagcagctttgtttgccattagtagtttcttttcaccattgatttccgtggtccctgctcaagcaacagcgccggcattgattttagtcggtgtgatgatgctcgcttcatttgcggatatcaattggtcggatcttgaagaagcagttccagcattctttgcttcgatctttatgggactttgttacagcatttcttatggaatcgcagctggttttatcttttacgcaatcgttaaagtcgtaaaaggaaaattccgcgaagtatctccaattttgtgggtcgtaaatattctctttattttgaacttcattattttagctgtgatcagctagtaccaatcaataaagagcactgatttctggtcgtgcttttgacaatgaactatccaaactataacggattctttctttggtcgatgagctgctttatgtgggctgtaaagaacaaagaaggcgaaatcggttgtagtggggatagttttattttgtagacagatcacacaatcttctgtcttttttaattttactattttaaaaaatgcggtatagtttaagagaaagagggttttgacatgaaaattgattggaaacgaaatctcctaatttcttggattggctgtttttttactggtgcaagttttagtttagttatgccgtttattccgctatatattgaagagttgggggcgccaaaaagccaaatcgagctgttttcaggtctggcaatctcagtgactgcgtttgcagctgcaatcattgcaccggtttggggaaatttagcagatcagaaaggtcgcagattgatgatgattcgggcggctgctggtatgacagtcaccatgggctcattagcctttgtaccgaatgtctactggctattgattatgcgcttctttacggggatcctttcgggttatattccaaatgcgacagcattgattgcttctcaagccccgaaagaaaagagtggctgggcactaggaacattagcaaccggagctatcgccggaaacttgatcgggccttctatgggtggtgctttagcacagtggtttggtatgaagaatgtatttatcatcacagggatcgttcttttgatcacattgctgctaacgatctttttggttcaagaagatttcgcacctgttgaaaaaggggaccttctatctgtcaaagaaatttttggacaaatcaaaaacctacaactattgattggcttatttattacttcattgatcctgcaacttggtgtaacaagtatcagtccaattttgactttatatatccgtgatctaagcggcaatacagggaaccttttatttgtcagcgggttgatcgtatcgattgccggtgtttcagctattatttcttcgccaatattaggtaaagtaggggaccgctacggaaatcataaagtgttattaggaggactactgctttcattcctttgctttattccaatgggctttgttacgtcaccattccaattgggcgttctacgctttcttttgggcttctctactggtgcgttaatgccatcgatcaatacgttaatcagtaaaatcactccaatggaaggtgttagtcgaatttatagttacaaccaaatgttttctaactttggacaagtgcttggtccaatggtcggttcaaccgttgcccatagttttggctacccagccgtgttttgggtaaccagtgcgtttgtctttttgaatatttgtctttctacatttaatttccgtaaaaattttcataagcacgatctcagttgaaaagaaaaaaaaaccagttacaatgaaggtaactggtttttcttctattaatgacttgtcttttttggcgaaggtgcaatcaaaccaagaaggataattagtacacctgctaccaaagagatgattgaggtcaattggaaatcataagtagctcccgctagtgagctgcctagatagccgacaacttggcctaagataaatgtccaaaataatgttgctaagtagcgcatgacgacacctcttttctgcgtatcttgcttttcgactttagtttatcacaaaaaatttcaatgtaaagattttcacattttcatttattcttttcaaattagaaataaagcagaaacaaacggaattatcattttcggagggattttctatgtatcatcaattgacaaccttaagcgcgtattccttacttcaaagtacgatcaaaattcctcgttatattgctgctgccaaaaaagctggttataaagttttggggctggcagatcacaatgtgttatatggagccttagaattttatcagcaatgccaaaatgccggaatcaaacctgtgattggtgtattattcgattgcacgtttggcacgtccactatgcgttttccattgtatctttttgcaaagaatctatcaggctaccgattattgatgcgcctttccagtgagaaaatgatcaacggtcacttggatctatctgaatacttaacgttaccagatctgtttggtattttgccgcaagggcaaggtttctctccagatcaatcggaagacttggcacagctttctcgagcattgacagactttgtcgctcgttttgatcaaaagagtcttttcctgggtgttcaaaaagcagcggcaacgccagaaagagagtggtttcaacagcacggtcttgagctgtgcgcttatcaacccgtagcagcactggaacaagcagaactatttgctgttcaagtcatggaacatattaagaacggtactcagatcgaagattttcgtaaagcgaaggaacaatcttccgaaacgtattatttagaacagcctgcggaactgattcaggcatttggagagaattcagaagcattggtaaataatcagcgaattgcagaagaatgtactctgacgattcctctccatcaacgtttgctcccgcatttccctttagaagaaggggaaaatgcggctgattttcttagaaaactgtgttttgaaaagttgtctgaacgtattacgcaggtcacagatatttaccgtcagcgtttggattatgaactatccgttattcatacaatgggatttgacgattactttttgatcatttgggatgtgatggattttgctcacaagaacgaaattgttaccggcgcagggcggggctcagcagcaggttcattagtagctttcgtattagccatcaccgatgtcgatccaattgaatatgacttgctgtttgagcgtttcttgaatcccgaacgctataccatgcccgatatcgatttagatatacctgataacagacgtgatgagattttgcgttatgtccgtcaaaaatatggtcaggagtacatggcgcaaattgctacttttggaacgatggcggccaaaatggtgctgcgggatgtttcacgagtgtttggtttgtcacaaagcgaagccaatcgctggtcaaaagccattcctaacgcattaaaaatgacattggctttagcttatgagcaatccaatcaattacgagaattggctaccttcaatgaacgaaatgaaacgatgtttgcagtggctaaggtactggaaggattgcctcgacatgtttccacccatgcagctggtgtggtgatcagcgacaagaatctcttggatctagtcccccttcaacaaggaagtgatgagatcctcttgactcagttcacaatgaatgatgtggaaacagtgggattgttaaaaatggattttttaggattacggaatctttcaatcattgacaatactttaagagggatcaagcgagttacaaatgaaacagttacccagaaagctattcctttaaatgacccagctgtgctgcgactatttcagcaaggcgatactgccggaatctttcagtttgagtcagcggggatcagaaatgttttgcgaaaacttggacctgaaagtatcgaagatatcgcagccgtcaatgcgttgtatcggccaggacctatgcaaaatatcgatacgtttattcgacggaaaaaaggacaagaaaaagtcgtttatccggatgctgctttagtgccgattttacaaaatacttatggaatcattgtttatcaagaacaaatcatgcaagttgcttctaaaatggcaggcttttctcttggtcaagcagatatcttgcggcgagccatcagcaaaaagaaaaaagacgtcctagatgaagaacggcgccattttgttgaaggagccgtagccaaccatttttccgcggagaaagcagaagaagtttacgattatattgagcgttttgccaattacgggttcaatcgttctcatgcgtttgcctactcatttatcggcttccaaatggcgtatttaaaggtacattatccagggccattttttgctgcattattgcactcggttaggaataatccaggtaaattaaaagaatatttgaatgaagcgactcggtatggtgtagcaatcttaccgccgtccatcaacaagagtggctatagtttctatcttcaatcggaaaaacagattcgttttggctttagcagtgttaaaggaatacgtagagacctgattcaagatattttagatgaacgaaaggagaatggaacattctcctccttagatcaattcctgttgcgcttgcatcaaaagaataacaaatggctgaaagaagattatatccgtccgttgttaagtattggtgcgtttgatgaattggtcactaatcggaagcaagcacttatccaattagaagggaaaatccaaaatatcacctatagtggcggcagtctcgatttgttagagacaatggctctcaaagaagccgaagtcgctgattatgacttagagcaaaagttagcgttggaagaagaatatctaggggtttatttatcagggcatcctgtccaacaatatcagaagctgcaacagttgaagcagacgatagcaatcgctgacttagttcccaacgaacgtgtccggatactattttatgtgcgtcaaattcgagaaatccgtacaaaaaaaggagagcaaatggcgtttcttgaaggaacagatgctagtaaagaagtctcaatcactgtttttcccacattgtatcgtcacatacgatctgacgttgcagaaaacgtcgtcttgtatgttgaaggaaaagtggaagtaagtcgttacaatggtgaaatacaactgattgctgataaaatagagctagctgaaaaagcgcaagcacagctaacagatcaaacgtgttatctgaagatcacacgtgatgttgagacgaaccatttgcaagaattgtcgcagttgctgagaaagcatcgaggccgggttcctgtggtgttgttctatgaaagcaacgggaaaaaagtgttgctgacggaagagaactggctaaaaaaagacgaagaaatggaaagaaagcttgggcacttgttgggagaggaaaatgttgttttcaagtaattttccgaaaacgttaaattttacttacacttttttcaactttttcccactatttcaagacatttctctggaataatggtaaaatactactcgtggttattacttgaaaagtatcaaataagggagttccaattccctaaacaaatctactaatgaggtgaatggataatgaaacgcattggaattctaaccagtggcggcgatgcgccggggatgaacgcagcggttcgggcagttgtaagaaaggctatctttgatgggctggaagtatatggaatcaattacggctatgctggtttggtagctggagatattcgccgtcttgatgtggcagatgtaggtgacaagatccaacgaggcggtacattcttgtactctgcgcgctatcctgaatttgcgacacaagaaggtcagttgaaagggattgaacaactgaaaaaattcggtattgaagggttggtcgttattggtggcgacggctcttatcatggtgcgatggctctaacacgccatggttttccggcgatcggtattccaggaacgattgacaatgatattcctgggacggactttactatcggttttgatacagcaatcaatacagtattggaatcaatcgaccgaattcgtgacactgcaacttctcacgtccggacattcgtaatcgaagtaatgggtcgtggtgcaggtgacattgcgctttggtcaggagttgccggtggggcagatgagatcatcatcccagaacatgactttgatatggccgttgttgcgaaccgaattcgtgaaggacgggaccgcggtaagaaacactgcttgatcgtcttagcagaaggcgtgatgggcggaaacgaatttgctgataaattatctgaatatggcgatttccacacgcgggtatcgattttaggacacgttgttcgtggcggatcaccaagcgcaagagaccgcgttctagcaagtaaatttggtgcttacgcagttgagttgcttcaacaaggcaaaggcggattgtgcatcggtatcgaaaacaaccagatggttgctgcagatatcatcgaaacgcttgaaaacaatcgtcacaaaccagatatttctttatacgacttgaacaaggaaatttccttttaagtttaggaagtatgaaacgcaacagtaattttgtaaaaaaagcttattaagctattttaaataaatgaataggagcgtttagtaatgaaaaaaacaaaaatcgtcagcacattaggaccagcaagtaatagtgtagaaattatttctgaactgatcgaagccggtgcaaatgtcttccgtttcaatttttctcatggagatcatgaagaacaattaggacgtatgacaatggtgcgtgaagcggtcaagaaaactggtaaagatgtagggattcttttagatactaaaggagcagaaatccgtacaaccgttcaagacacaactgaagcagattatggtcgtgccggctatatccaattcaacgttggtgaccaaacacgtatctcaatggacccagaacacaaaggaacaaaagaaaagattgcagtgacctatcctggattatttgacgatgtatatgtaggcggccatatcttatttgatgatggtttgatcgatatggagatcatcgaaaaagacgaagcagcacgtgaattagttgttgttgttaaaaatgcaggaatgttgggttctcgtaaaggggtcaatgcacctggcgtatcaatcagcttgcctggtattactgaaaaagatgctgacgatattcgttttggattagacaatgatatcgacttcatcgcagcttcattcgtacgtaaagctcaagacgttttagaaattcgtgaaattcttgaagaaaagaacatgactcatgtacaaatcttctctaaaatcgaatctcaagaaggtatcgacaacattgatgaaatcatcaaagtttctgacggtatcatggttgctcgtggagacatgggtgttgagattccagcagaagaagtaccaatggttcaaaaacgaatcatcaaaaaatgtaatgcggtaggtaaatcagttatcactgcaactcaaatgttagaatcaatgcaacaaaatcctcgtccaacacgcgcagaagcttctgacgttgccaatgcagtctttgacggaacagatgcaaccatgttatctggagaatcagcaaacggagactatcctgtacaagctgttgcaacgatggctcgtatcgatatcgaagcagaaaatgctttagcagaaatgagtactttccaaatcaaccaatttgataaaactgatgtaacagaaacaattggtctttctgtggcacgtgcagctaaaaatcttggcgtaaaaacaatcgttgctgcaactgaatctggctatactgcgaaaatgatttcaaaatatcgtccagatgcagatatcttggcagtaactttcgacgaacgtacaaaacgtggtttgatgttaaactggggtgtttatccaacagttgctgaaaaaccttcaacaactgacgaaatgttcgaattagcagctaaacaagctgtggatcttggttttgccaaagaaggcgatttgattttgatcactgctggtgtgccagttggagaacgtggaacaacgaacgtgatgaaaattcaaatgatcggttctaaattgcttgaagcacaaggaatcggtgaaaaatcaatcgtttctaatgccgttgtagccaacagtgcagaagaagcaattgctaaagcaaaagatggcatgatcttagttgttccaacaacagataaagaatatatgcctgcaatcgagaaagcagcagcacttgttgttgaagacggcggtttgacttctcatgcagcagttgtcggcattgcgaaagaccttccagtgatcgttggggcaaaagatgccacaacaacgatcaaagatggtgaattgattactgtggattctcgtcgtggaatcgtctaccgtggagaaacaacagctatctaatcttctttcgaaagattgattaatggaggcaacaggctcgtgcataagtagcgagtctgttgtttttttctctaaaagcaatcacttttttgtgcgtaaaattacagctgtagaaatgaaaaaggtgtcaagaaaatttcattgacaaagggaaataacccctgtataattgcttttgttgcttaggggtgataaaaatgaaatggtctttattggaattaaaaaaataccaagagacaccgctaatgttcgacgaaacgttgaacttaaaaaatcaattgataaaacgcgatggacagatcattgatttgtctcctgtgaaaatcactggcatgatgtctgttggaaaacatgaatatctcctacattatcgagtggagacaaccatcacgttaccttcaacacgctcattgactccagttgctttgccaatggattttacagtggatgaactcttcatgacaccagagcaatttcagcggcgagatgaaatgattccagaagaagatgtcttgatcattgaaggtcagacgatcagtttggatgattcagttgctgataacctattacttgcgattcccatgcaagtccttactgaggaagagaaaaatagcacagaaatgccgtcaggaaatgactgggctgttttatcagaagaagactatgcaaaccaaaaagaagcgcaagcccaacaaattgatcctcgtcttgcaaaattatcggaactgttcaatgattcagaagatgataacgcgtaggattggaataaattgcagcctcaaggttgctttcatttacaaggaggtgtagcaaaatggcagtaccagcaagaagaacttctaaagcgaaaaaagcaaaacgtcgtactcattacaaattgacaatcaacggtttgaacgaatgtgcaaactgtggtgaaatgaaaaaaagccaccatgtatgctcaaactgtggtcattacgatggaaaagatgtagcaacaaaagaagcataatccttttttacagaaaaagggatttcaaaatcctaaggctaaccatggagccttaggatttttctttttgtttcagattagtttcatgaaaactagaacttttctgaaataattcttactctttgaaagagaatagttcaaaacaactatcttttgcgctataataaaacagataactgaatcttaggaggatgagtgatgacaaaacaacaaatcggcgttgtcggtatggcagtcatgggaaaaaacttagcgttgaacattgaaagccgcggttattcagttgccctattcaaccgtacaggatctaaaacagaagaagtagtaaaagaacatccagataaaaactttaaagcaacctatacgattgaagagttcgtacaatcgatcgaaacaccacgacgcattcttttgatggtcaaagcgggttttgcgacagacgcaaccatccaagaattattgcctcatcttgaaaaaggggacatcttgatcgatggaggaaacacattcttcaaagatacgatccgtcgtaatgaagaattagcaaattctggtatcaactttatcggtaccggagtttctggtggagaagaaggcgcattgaaaggcccgtcaatcatgcctggcggacaaaaagaagcgtatgagttagtggctcctattttggaacaaatctcagcaaaagcagaagatggcactccttgtgttacctacattggaccaaatggtgcaggacactatgtaaaaatggttcacaatggtatcgagtatggagatatgcagctaattgctgaatcctatgatttgatgcaaaaaattctagggctatctgtttctgaaatggcggagatcttctctgaatggaataaaggggaattagatagctacttgatcgaaatcacagcagacatcttaacacgcaaagacgatttaggtactgggaaaccaatcgttgatgtgattttagatgctgccggcaacaaaggaacggggaaatggacgagtcaaagtgcattagatcttggtgttccactgccgttgatcacagagtctgtttttgcgcgttatatttctgcttataaagaagaacgagtgaatgctagccaagtcttaccaaaacctgaaggattcgaatttacaggagacaaacaagaatttgttgagaaaattcgggaagcattgtatttcagcaaaatcatgagctatgcacaaggttttgcgcaattacggaccgcatcaaaagagtatgattggcaactgccatttggtgaaattgctaaaatctggcgtgcaggttgtatcattcgtgcgcaattcttgcaaaaaatcaccgatgcttatgaaaaagatacggatatcgaaaacttattgcttgatgactatttcaaggaaatcacaaaacgctatcaacaatccgttcgtgacgtcgtagcattggcagtccaagctggcgtaccagtcccaacattctcttcagctattgcttattttgattcttatcgctcagatcgtttgcctgcaaacttgatccaagcacagcgggattatttcggtgcccatacgtatgaacgtacggacaaagaaggaatttaccactactcttggtatgaggaagaataagtcgaacaattgagaacaaattaagagaatgaccgaacagtgagaactttcggtcaatctcttttttattttttagatacatgataaaataaagcagatagtgtctaactatatgcagaataaccgataaaggagctctaactaatgagtaatattctaatcattgaagatgaaaagaacttagctcgattcgtggaattagaattaaagcatgaaggctataataccgaagtacattataatggcagaactggattggatgcagcgttgaacaatgaatgggatgccatcttacttgatttgatgctaccagaactaaacggattagaagtttgccgtcgtgtgcgccagaccaaaaatacgccaatcattatgatgacagcaagagattcagtgatcgatcgggtctcagggctagatcacggagcagacgattatattgtgaaaccctttgcgattgaagagctactagctcgtttgcgtgcgctgttacgtcgaatcgacattgaaggagacaaaaatgttgccaagcaaacgacgatcacttatcgtgatttaaccatcgagaaagaaaaccgtgtggtgcgtcgaggcagtgatgtcattgaattgacgaagcgtgagtacgagttgcttcttactttgatggagaacgtcaatgtcgtcttagcccgtgatgttctgctgaacaaagtttggggttatgaaacagaagtagaaacaaacgtagtcgatgtgtatattcgttatctacggaataagatcgacgtacctggagaagaaagctatatccaaactgttcgggggacaggatacgtgatgcgttcgtgagcttaaaaaaaagaatgaaaaaactaaaagaactgaaggggccttctttgactgtgaagtgggccttcgcaagttctttctttatatttgttgtttttacaatttttgcagtcatcacttacaaaacgtctatcaacctgcttgtggctaaagaagaaaataacgtggagcgtacgatgtcggaagtagcttctaggttagccaattcagaccaagaattgacattggtgcgtacctatcgcaatttaactaagaacgatagtggtgatacgagcatctacgaccgaacttcaacaattgatgggaacttaatgaagatcgactcgtttatttccgagttaggtcagtctcctttgagcttatttgtttataatctgaatcaggaattgattttcaaaacccatgaaaataatctttctctgatcgatgtgcagcgaaagccgcccacgatcgtgacattggacaatattacaggctttttgtcgatccagccaatctactcaaaagaaacgagagaaaaaattggttatgctcaaacattttatgaactgacctcattttatgaaattcgcagtaagctcttgttaacgctaatcatacttgaagtcgtttccttgattctcagtagcgttttaggttttttcttatctgcttatttcttgcagccactgaaagttttgcgggatacaatggaaaccgttcgaaagaatccccaatcgaccgtgcatatgcctgaactgaatacaaatgatgaattatctgatttggcagacatctttaatgagatgctcgaccgtatgcggctatatatcgagcagcaagaacggtttgtagaggacgtttctcatgaattacggacaccagtggcaatcattgaaggacatatgagcctgttgcagcgctggggcaaggacgatccagaagtattagatgaatcgcttgcagccagcatgcaagaaatcagtcgaatgaagacacttgtgcaggaaatgctcgacctttccagagctgagcaagtagatgtccactatgcgaatgaaacgacaaaagctaaagaagtcgtataccaagtatttaataattttaaaattctttacccggaatttgttttcacattggatgatgatctttaccacgaattgactttaaaaatttatcggaatcatttcgaacaaattattattatcatcttagataatgccgtcaagtactccacagatcgcaaagaggtccatttatctatttcttctgatcgacaaacgtttgagattgcaattcaggattttggtgaaggaatcagcaaagatgacttggataaaattttcaatcgattttatcgagtggataaggcgagagcaagaaccaaagggggaaatgggttaggactatccattgctaagcaattattggaaagttataaagggcgcattactgcagaaagtgtgattgggcaaggaacgatttttagaatatatattcctgtggttcaatctagtaaggatgttttgaaatagcgcagatcctctgcgaagaaaccagctggttgttgtaggttagcgacaatcagctggttttttctttataagggatcttacttaatggacagcgtttctgcttgttcatataaacaggaacgattgaggaacacgaatagttataaaacgcaattattgctataaaagcgaacgatgagataaagaatagaagaaagattcggctaaaaaaaatgttgagaaaaagctttgttttttgttgatttttcgcagtagaattgctatattagtatttgtctttgtgatagtcactgtttaaatctttcaaatattttttcaaaataaatgttgacgaagatcaagacaaatgttattataacaaagtcgtcagaaagcattaggtaaaaaaacttaaaaagttagaaaaaactttcaaaaaagttgttgacacaaagctttcgagatgataagatataaaagtcgctgagagataaagagtgattaaataacaatcacttgaaaaagcttttaaaaaaagagttgacattcacttgttgatctgatatgatttaaaagttgctaacgcagcgcagtagacctttgaaaactgaacaaagcaagcaaacgaaccaatgtgtagggcgcttcattatatgaagcaaaatacatgcaagcgatagctagcaaagttaattttatttgagcttaacgatcctatggatcgttcaaacaaatcattatgagagtttgatcctggctcaggacgaacgctggcggcgtgcctaatacatgcaagtcgaacgctttttctttcaccggagcttgctccaccgaaagaaaaagagtggcgaacgggtgagtaacacgtgggtaacctgcccatcagaaggggataacacttggaaacaggtgctaataccgtataacactattttccgcatggaagaaagttgaaaggcgcttttgcgtcactgatggatggacccgcggtgcattagctagttggtgaggtaacggctcaccaaggccacgatgcatagccgacctgagagggtgatcggccacactgggactgagacacggcccagactcctacgggaggcagcagtagggaatcttcggcaatggacgaaagtctgaccgagcaacgccgcgtgagtgaagaaggttttcggatcgtaaaactctgttgttagagaagaacaaggatgagagtagaacgttcatcccttgacggtatctaaccagaaagccacggctaactacgtgccagcagccgcggtaatacgtaggtggcaagcgttgtccggatttattgggcgtaaagcgagcgcaggcggtttcttaagtctgatgtgaaagcccccggctcaaccggggagggtcattggaaactgggagacttgagtgcagaagaggagagtggaattccatgtgtagcggtgaaatgcgtagatatatggaggaacaccagtggcgaaggcggctctctggtctgtaactgacgctgaggctcgaaagcgtggggagcgaacaggattagataccctggtagtccacgccgtaaacgatgagtgctaagtgttggagggtttccgcccttcagtgctgcagcaaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatcctttgaccactctagagatagagcttccccttcgggggcaaagtgacaggtggtgcatggttgtcgtcagctcgtgtcgtgagatgttgggttaagtcccgcaacgagcgcaacccttattgttagttgccatcatttagttgggcactctagcgagactgccggtgacaaaccggaggaaggtggggatgacgtcaaatcatcatgccccttatgacctgggctacacacgtgctacaatgggaagtacaacgagttgcgaagtcgcgaggctaagctaatctcttaaagcttctctcagttcggattgtaggctgcaactcgcctacatgaagccggaatcgctagtaatcgcggatcagcacgccgcggtgaatacgttcccgggccttgtacacaccgcccgtcacaccacgagagtttgtaacacccgaagtcggtgaggtaacctttttggagccagccgcctaaggtgggatagatgattggggtgaagtcgtaacaaggtagccgtatcggaaggtgcggctggatcacctcctttctaaggaataatacggaagactacacatcgtttgcctttgttcagttttgagaggtctactctcaaagataaatacccggggccttagctcagctgggagagcgcctgctttgcacgcaggaggtcagcggttcgatcccgctaggctccattaacgacagaggtcgttaagtttgttcattgaaaactggatatcgaagaaaatcaaaacaagtaacacacaccgagttgacaagttaaagagttttttaataagttcaacgcttattttcttgagcaaccttctatcgctagaagaagtactcaccgaccgtaaggtcaaaggttaagtgaataagggcgcacggtggatgccttggcactaggagccgatgaaggacgggactaacaccgatatgctttggggagctgtaagtaagctatgatccagagatttccgaatgggggaacccagcatcttttataggatgttacacagttgtgaatacatagcagctgtgaggtagacgcagagaactgaaacatctaagtacctgcaggaagagaaagaaaattcgattccctgagtagcggcgagcgaaacgggaaaagcccaaaccaacaagcttgcttgttggggttgtaggactccgatatggtagttgaaacagatagtcgaaatacttggaaaagtatgtcaaagagggtaaaaaccccgtagatgaaatctggctcacacctaggaggatcctgagtacggcggaacacgaggaattccgtcggaatccgggaggaccatctcccaaggctaaatactccctagtgaccgatagtgaaccagtaccgtgagggaaaggtgaaaagcaccccggaaggggagtgaaatagatcctgaaaccgtgtgcctacaacaagttagagcccgttaatgggtgatagcgtgccttttgtagaatgaaccggcgagttacgatagcatgcgaggttaagttgaagagacggagccgcagcgaaagcgagtctgaatagggcgaatgagtatgttgtcgtagacccgaaaccatgtgatctacccatgtccaggttgaaggtgcggtaaaacgcactggaggaccgaacccacgtacgttgaaaagtgcggggatgaggtgtgggtagcggagaaattccaaacgaacttggagatagctggttctctccgaaatagctttagggctagcctcggaattgagaatgatggaggtagagcactgtttggactaggggcccatctcgggttaccgaattcagataaactccgaatgccattcattcatatccgggagtcagactgtgagtgataagatccatagtcgaaagggaaacagcccagaccaccagctaaggtccccaaataactattaagtggaaaaggatgtggggttgcacagacaactaggatgttggcttagaagcagccaccatttaaagagtgcgtaatagctcactagtcgagtgaccctgcgccgaaaatgtaccggggctaaatagtttaccgaagctgtggagtgcaccgtaaggtgcattggtaggagagcgttctaagggcgttgaaggtagatcgtgaggactactggagcgcttagaagtgagaatgccggtatgagtagcgaaagacaggtgagaatcctgtccaccgtatgactaaggtttcctggggaaggctcgtccgcccagggttagtcgggacctaagccgaggccgacaggcgtaggcgatggacaacaggttgatattcctgtacccgttgtttttgtttgagcaatggagggacgcaggaggctaagaagtgcagactgatggatatgtctgttcaagcagtgagtcttagtgggagtcaaatgcttctacttttaaggacaagctgtgatgaggagggaaataatagtaccgaagcttctgatgtcacactgccaagaaaagcttctagtgagaaaacaatggcccgtaccgcaaaccgacacaggtagtcgaggagagcatcctaaggtgagcgagagaactctcgttaaggaactcggcaaaatgaccccgtaacttcgggagaaggggtgctgctctaacgagcagccgcagtgaataggcccaagcgactgtttatcaaaaacacaggtctctgcaaaatcgaaagatgacgtataggggctgacgcctgcccggtgctggaaggttaagaggagtgcttagcgtaagcgaaggtacgaattgaagccccagtaaacggcggccgtaactataacggtcctaaggtagcgaaattccttgtcgggtaagttccgacccgcacgaaaggcgtaacgatttgggcactgtctcaacgagagactcggtgaaattttagtacctgtgaagatgcaggttacccgcgacaggacggaaagaccccatggagctttactgtagtttgatattgagtgtctgtaccgcatgtacaggataggtaggagccgtagagatcgggacgccagtttcgatggaggcaatggtgggatactacccttgcgttatggccactctaacccgcagcccttatcgggctgggagacagtgtcagatgggcagtttgactggggcggtcgcctcctaaaaggtaacggaggcgcccaaaggttccctcagaatggttggaaatcattcgaagagtgtaaaggcagaagggagcttgactgcgagagctacaactcgagcagggacgaaagtcgggcttagtgatccggtggttccgcatggaagggccatcgctcaacggataaaagctaccctggggataacaggcttatctcccccaagagtccacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgttggaaatttgagaggagctgtccttagtacgagaggaccgggatggacttaccgctggtgtaccagttgtctcgccagaggcatcgctgggtagctatgtagggaagggataaacgctgaaagcatctaagtgtgaagcccacctcaagatgagatttcccatttctttaagaaagtaagatccctgagagatgatcaggtagataggtcagaagtggaaggccagtgatggttggagcggactgatactaatcgatcgaggacttaaccacgattgaaaaaagcaaggaaactcggaagagttttgattcttcgatccagttttgagtgagcaatacttactcaattgaatagtgtggtggcgatagcgagaaggatacacctgtaaccatgccgaacacagaagttaagcttcttagcgccgattgtagtgaagggtttccctttgtgagagtaggacgtcgccacgctgtttcattccggcatagctcagttggtagtagcgcatgactgttaatcatgatgtcgtaggttcgagtcctactgccggagttctcttacaagagaaaaaagggtattgagcttcttttaggctggagagttgtccgagaggccgaaggagcatgattggaaatcatgtagatggctaccgctgtctcaagggttcgaatcccttactctccgttataatcttggtccgttggtcaagtggttaagacaccgccctttcacggcggtaacacgggttcgaatcccgtacggatcattacaatttaatgaacacccggaggtttagctcagctgggagagcatctgccttacaagcagagggtcagcggttcgatcccgttaacctccattacggtttggtagttcagttggttagaatgcctgcctgtcacgcaggaggtcgcgggttcgagtcccgtccagaccgtttcattattattgtaaatacaccatgttattttggctcggtagctcagttggtagagcaatggattgaagctccatgtgtcggcagttcgattctgtcccgcgccaccatggaggagtagcgaagtggctaaacgcgacggactgtaaatccgttccttcgggttcagtggttcgaatccactctcctccattttataggggcatagtttaaaggtagaacagcggtctccaaaaccgttagtgtgggttcaattcctgctgcccctgccattattattttaaaaagttttcttatcacggcgggtgtggcgaagtggttaacgcaccggattgtggctccggcattcgtgggttcgattcccatcactcgccctttcatttttggggtatagccaagcggtaaggcaacggactttgactccgtcatgcgttggttcgaatccagctaccccagttcgatttacatttttgtaaattgcagaaatagtataatggcggtatagccaagtggtaaggcagaggtctgcaaaaccttcatcaccggttcaaatccggttaccgccttagtacgatactaatatttgcgttatgccgacgtggcggaattggcagacgcgctggactcaaaatccagtgcccgcgagggcgtgccggttcgaccccggccgtcggtattatcggtacatcattcgttcgtacgattgatgtatcgatttttatcctaatattggttgaagatcaactggttggataaaaaaagctgttaaaatttagtaagtacttgagtgatctgcaatcatgccgacgtggcggaattggcagacgcgccagactcaaaatctggtgtccgcaaggacgtgccggttcgaccccggccgtcggtataacaatgaagcatcaacgtaaggaatacgttgatgctttttttatttaaatgtgtgctttcttaaattttgaaaggattgatctttatcagcaaaaagaaaaagtgttgcgaattactgttttagaaaatttactagaatgcgtatttattttcactagctgagaatgaatgaaaaaagttgcattagttaccggtgctggtcaaggtattggctttgccatagctaagcgtttgtacaaagatggctttgacgtggcaatggtggattacaatgaaaactctgtaagagcggcagcgaaagagcttggtgaacatgcgattgctatcaaagcagatgtttcgaaacgggatgagattttttcagcagttgataaagtaatagatgtctatggtgacttatcagtgattgtaaataatgctggggtagcaccgactacaccgatagagtctattactccagaacagtttgaaaaagtttattccgtgaatgccgggggcgtattatggggaacacaagcggcttctgaagcatttcaaaagttgaatcatggtggaaaaatcatcaatgcttgttcacaggcaggtgttgtgggtaatcctaatctcatgttgtacagtagctcaaagttcgctgttcgtggtatgacccaaatcgctgcgcgagatttagctgactatggtattactgtaaatgcttatgcaccaggtattgttaaaacaccgatgatgatggatattgcgcatcaagtaggtgctaatgctggtaaagatgatgaatgggggatgcaaacttttagtaaagatatcgcattgaaacgtttatctgaacccgaagatgtttcggcagttgtttcatttttagccagtgatgatgccaactatataactggacaaacaatcattgtggatggcggaatgcagttccagtaatcaataagttgttgatctaggattgggcgttcggatagtcccgcaggttttcagttgattgaaactcaccaaaatagtggcattttcttgttcaattgttactgtaagaaaaactaaatgatagtagttatgtaatttgctgtttcatgcaaatcatcgaatgaatgacccgattagatagattctaatcgggtcattcatctgtatacgaaggaacgatcgaaaaagtctgagaatggagttatcacaaagaatagaacaaaagataaagcaattctttagcccttggcaaatttgatgatttcaacttccatgggggcgagggtgagttcacaaacttttctttttgataataatgctgtaccttccgatagaaattgtacttgttgtgaatcgtttgtatgattaagtaggaataagaagatatgggttggtccttgtcgaacagtgacagacaactcgctgttttcttgcaaatacctctcagcaactttttttagttttgcatcactaaaaatgtcgttcaataagtcggtcaacccttcttggtctaactcggttcctaaataataagccagtcctttgccaaaccgatgtttagtgatagctggtgaatctttaaggaaatcactcgtgaaggtagccagtggggtagcaccttgtaagtggatcacttcttcccactgacgattttcataaaatttatttttaaaatgcacttgttgctggatttccggttttaaaggctgaaattcttcaactatgatccctaatacctctttaaaaagtcctggatagccgccaagatagacttgatcgttttcgttgacgattccgctgaagaaatttgtcaagaatgttccaccatttgctacaaattctttgactttattgccgaattcttctgatgcagagtacaaattatacgcaatcacaaggggatagccgtctagtgattcagatggatgaatgaaatcaacagcaatgttcaacgctcttagagcggcatataacgccctcatttggtgaatatagcgaatattggtattcggcttcgcatctagctcaagggcccaccaattttcccaatcaaatacgatagcaatatcggcaacaaaccggctgccaacgatgtcattcaactgttttaattcatttcccagagcagcacattctcgaaaggtgcgacttgtgtgtggatcaccatgagggactattgcactatggaatttctctgcccctccttgtgattggcgccattgaaagaacatcatgccatcggagccatgagcaagtgcctcataactccataagcgcatttgaccgggttttttgacgccgtttacttggcgccagttgaccgcacttggggcttgttccatgataaaaaaaggtttcttttttaaacttcgcatgagatcattggctaagaattggggatagggcagagattcaaacggattaggataggcattccagctaacgacatccatttcagaagcccatttgaagccatcgacatatttatgaagacccatcaaattcgtcatgaatgggatgtttgacgagaatgtttgaattgcctttttctcgatctgataaatttccagattcatatcagaaatgaagcgacgataatcaagctgttgacaaggattcttaaaagtcggcatttcttctggtaggaaaatctcatcccattcttgataggtttggctccaaaattttgttgaccaagccgtattcaatgcttcaattgtttggtattttttttctagccaattttggaaactggcacgacagtttgggcaataacattcatggatgtgacaagtatattcattattgatatgccacatcacaactcccggatgttggctgtatcgtttggcaacagcttcactgagccgacgggcatattcccgataaatcggtgaagtcgggcaatagtgctggcgagaaccatgtaccaaccgattgccatgaatggtcatcggcatcatttcaggatattttttgactaaccatgcagggggcgaagctgttccattggctaaatcgatagcaatattgttttcataaaggagatccatcagccaatccaaaaaagtgaaatcaaatgttgattcatttggttgaatgtttacccaaccaaaaatattgatgctgacataattgactccaacttctctcattaagcgcatgtcttcctttatcgtttcttgtgaccactgttcaggattgtaatctgcgccgtaataaatttgtttttgatcaaccatctgttaaacttcctttctcgtagtaagacatatttgtttcaatcataacaaaaaaagtaaaagctgaaagcgttggcaaaaaggtgcatgaaataatacaaatatctgtaaaatgttcaaaccgatctcaatacacgagaaccatattacttgctgtttttttattttcaacctacaattaaatataattgataacactcaattcttaatgaagctgtattattattagatgttcttttatatttatgcacatcttcagcattttgaaatgagcgaaaggaatggttggatatgtcaaaacctatacaaatattttcagaaattgaaccgttaaaacgggtgatgctccatcgtcctggtgcagaacttgaaaacttgatgccggattatttagaagacttgttgtttgacgatattccatttttggcacaagcccaacaagaacatgatttttttgcaaaagttttagtggagaatggctgtgaagtggtttatttagaagacctggctgctgaaacattacagctttcaggatgtaaggaagctttcttggatgattatttgcaagagacgaaaattcaagatcaagatgtattaaatgaagtcagagactattttctttcgattaaagacgaacgagcgtttattgatcaaacgatggcggggttaaaaaaacaggatctttccatatcgaagactgcaagtttctcagcaatgcgggaaaatgattatccatttattattgatccgatgccaaacctttattttacaagagatccgtttgctattataggacatagcatttctcttaaccggatgttttccgaaactcgtcgaagagaaacgctttatggacagtacattttcaagcaccatccgcagttcgccaagccatcggtcaatttcttgtatgatcgagaagaacctgcacgtatcgaaggtggggatcagcttgttttgtcccagcatgtattagcgatcggtatttctcagcgtacagaagtgcactctatcgaaaaaattgctgaaaacattttttcaatggaaccgtcatttgaacatattttagcatttgatattggttctgaacggaaatttatgcatctggacacagtctttaccatgattgataaagacaagtttacgattcaccctgaaatagaaggtgaactaaccttgttctctattacaaagcaaggacaagaaatcaaagtagttgaagaaaaagatacgttagatcacattttatgccgttatttggacttgccggcagtcgagttgattcgttgtggcggcgacgatatcacggcagctgccagagagcaatggaacgatggatcaaacacattagccatcgcgcctggcgaagtgatcgtctatgaccggaatactattacgaaccaacttttagcagaggccggtattaaattacatcaaattccaggtagtgaattagtaaggggccgtggcggtccccgctgcatgagcatgccgtttattcgtacagctgattgatagaatgactagctgatttaagtgtttttttatcagcaaaaaacaggtggcatcacaaattaggacgtttaaaaaagatgagaggaagtcatttttctttcatcttttttttatttgattaaaaaacctccattataatgaaagggattacttttcgtgaaattgtgcaaaaaatttaaattttatatgtaatgattgtaaaaaaacagatgaaaccttgttatactacaaaatatatgttacggttatattagtgacgcgggtaagtgtgagtagatgacacttattaaattttaacaccatacgaacagcgatcgcttgattcgtaatggttttttttcgcgaaaaaaagtagaaagtaggtgagagaatgtctgtagatgccattcgtttgctgcaagaagcagaagactttgcagaacaaaaaaacacgaaagcggaagctaaaaaaaaacaactgatccatgaaagtcaaacaagaatttcagcattccagaaagaattggtacaaaaagaacgtgaagcacaacgaatgattgaagaaaaagttgcaacggaatttgagcaatcaaaacaaccccttgtgacaaaaacaaaagaggaagttgagacattgcgcacgatttcagctgagttgagagaacaagcattggcaataataataaataaggttgtgacatagatggcgattgcaaaaatgcaaaaattcagcctgttaaccttttacgaacaaaaagatgccgttttacagcagttacaagactttcaaggtgtcgaattgctttcttctgaaatgtattacgagtcagaggaaaccacaggcgtgttaacacccgttcgtgatgaacagaaacagactgaagaagtagaaaaccaatttgatcaagtaaattggggcctgcaattattagaggaatatgttccaaaaaaaggaatgctggaaaaacttcggcaaccaatcaagcgctacacacttcacgaattagcgcaagccgctcatacttatccttggcaagaagtttgtcaaacacttcgaaaacaagacaaacgtttacgattgatcgaacaagaaaaacgagagcttttggctcaagaagcagaactgaatagatggaaatactttgaagaccgtcctcagattttgaatgaattaaaaaaatcaggtggcctattaggttcgctcccaaattcagaatttgcggctttcacaaagggttgcgaaaaactgccactcgtttattttgaaacagtttatcaatcacaaacgactacatacttattcgttcttttccataaagatgttaaagataaagtaagttcccttttaaaaaagactgcattcgagcagtatacctatccctattcaggtctgccaaaagatgacctgcaacatgtaaaagaaaaatcccacgcattgattgaggaagaaaaatcaatcaaacactccttacgtgcaatgagcgaagagcagggacaattgcgtctcgtagcagagtatttagatggcgcgatcaaacgagctcagagtaatgaaaagttgcttcgttcggctcatgccgtagctatttcaggctggatccctgttgagcaagcagcagaactggagaaaaggatccaacaggccagcaaagatgctttttatcttgaataccaacaagtgaaagaacaagaaatcgaggatgttccgattttgttgaataattcgcggtggatacaaccctttgaagggttagtgcggatgtatagtttgccccagtatgatgaattagatcctacaccgtttatggcgccattttatatggttgcatttggaatgatggttgcagattttggctatggattattactgtttttggcaacattcttgggcaaaaaattctttcatttaagtaaaggattggaacaaaatttgacgctgtttcagctttgttcgattcccacgattatttggggcttgatttatggtaatttctttggctttgaattgtcattccaattgttatcagcccaagaagatgtcaatcagattttggtcttgtcgatcattttcggatatatccaaatcatgtttggattagctttgaagttttatgtcctttggaaacgaaaagatcagaagctacaggctgtttttcaggctggatcttggatggtctttttgatcagtgttgttctattggcagcaggaatgttgctgttgcctgattcgcctttacaaaccattggttttatcatgattatcgctagcttaggggcagttgtatttggcggtagtttagaaggcaaaacactagctggtaaaatcggctcaggactatatggattaatggatgttacgaattacgtaggggatatgatcagcttcacacgactcatggcattaggagtcgcaggaggcagtatcgcatccgcattcaatttgatcatcagttatttaccaatagctgcgcgtttcacagtcggtattttgctttttgtggcgctgcatgcattaaatatctttttaagctatttaagtgcgtatgttcatggtattcgtttacagtatttagaatatttcggaaaatttttcaccggtgggggacgagcatttgtacctttcaaaaccgatgaaaaatacgtagaagttatctcagaagagaaaatgcaggaggaaaagaatggaaaattggattagtttcttttatgaaaatggtgggttggtttttgccgcattaggtgtagctacagcgacaatttgtggtgggatcggttcaacgatcggggtcggtatgaccagtgaagccgctgcaggattgactgcagagcaaccagaaaaatttggacaggccttgatcttggaactgttgtcaagtacccaaggactatacggtttcgttatatcattcatgatttttggtcaaatgagcggaacgatctcccttgatagaggaatgtacctatttatcgcttctttacctattgcgttgacagcaatcgttgccggaagatggcaaggacgtgctgcaagtgccgctatgcagattttagccaagaaaccggagcacgtaacaaaagggatcatttatgtagcgatgatggaaacgtattgtatcttaggtttcgttatttccttcttgctagttttaaattaagagggggagaaagatgtctgatattacgcgattaaccgaaaaaatcacagcagatgctgaaaagaagtatcagttggtccttaatgatgcacaagtagaaattgaaaaacaggagcgtctcaaacgttctcaactagaagaacaactttctgatcgtttggcccaatttgaaaaagaaaaacgggcagaaatgtatttgcagatttccgatattcacattcagtctcgcaataaagtgcttgccgcgaagcaatccgttttggaagaattgtttagtgaggcacttgagcgcttgaaccaaatggaagccgctgattttcaagcattcgtcacaaaaggagtacaagaagcacaggtttttggtgaagttgaattggtattgggagaaaaaagtgcgcatctgctgacagaaggttcattgaaagagattcaacaaacgattcctgaatgtcgactaacagttgcaaaacaagttttgccgcgaaaaggcggatttttactgcgccgaggcgatattgagctgaactttacgtttgatgcgttgttggatgccagcaaagaagagttgagtcatacattactgcaattgatttttgaacagtaagcgggtgtaaaaatggaagatatcaaatacaacacgctgaatacacgaatacgaacctatgaagcggaattgatcagtcgcagccgttacgaacgtatgctttctgccaacagtgccgaagaagtttatgctcttttgcgagaaaccgtttatggtgattttatcaatgaagaagatcgagtccatgattttgaacaagtattgaccgcagaattaaaacgagtatatgaaaacttgtatcagctaacacctgatcgttctgtggtggattattttgcccttcgctatgattatcaaaatctgaaggtgttagtaaaagctaaattcatgaaacaagacttttctgaatttttggtaccgatcggaaccatgcctttaaatgaattgaaagatttggtcaacacaagaaaaagtgcgcacgcagagcagccaatgattgcttgtatcgatgaagtattttcctatatcgaaaattatcatgagattcaatccgtagatatcatttttgacaatcatttttgggaacatctttggtcaattggtaagcgatatgatgatccgtttttacaaggaatcattcaacggcaagtagatatttttaatatttcgacagcactacgtagttacgccatgaagcgtcatcgaggctttatcagcgctgttctagcagataatgggactctccctgcaaaagagctgttggaagcaatcacgacgtctttggaagcttttgtccagtatctgcaaaatacaccttacaaacatttgatcaatcacagctatgaagaactgcttgagaagaagacccttaatacgtttgatctgcgaaaagataactttttgatgggaaaattgaaagaacaaaaaatcgtgccattcggtccagctgcgatgatcggttacttgtatgcaaaagaaatcgaaagtaaaaatttacggattattttgattggaaaaatcaataaagtgccggaagagatattaagaagtcgggtgcgtgatacgtatgaataaaaaaatagcaatgatgggtggcaaaaactcaattttgcccttcaaaggtctaggaatcgatatctatcctgtagatgatcttgaagaagccgcacaacagctgcaggaaatggcagaagactatggggtgatcttcttgaccgagcgattgattgaacagttggagtcaatcattcgacaatacgaagaactacccacgccagccatcatccccatccccagcagtacagggagtctagggatcggaatggcacggatccagcagaatgtcgagaaagctgttggaatgaatatattagattcttaaaagagaagtacggcaactaggaggaatgcatgtggcatttggcacaatagaaaaagtatctggtcccttggtcacggcctcaggtttatcaggagctaagatccatgaaatctgtaaagtcagtgaaaaaggcttgattggagaaatcatcgagatcaagaaaggtctcgtgtcgatccaagtatatgaagaaacagcaggaattggaccgggcgaacccgttgaatcaacaggggctccgttatcggttgaattagcccctggcttgttgacagaaatgtttgatggtattcaacgtccattagatacctttatgaatcaaacagagagtgattttttggaacggggtgtgaccattgacccgctaaatcgtcaaaaaaaatggacgttcatgccgcaagtaaaagtaagggacaacgtacaagctggagacattctaggacttgttcaagaaacaacagccattgaacacaaagtgatggttccgccaggtgtgaaaggcactgtaaaggaaatcatggtaggtaattatgctattactgaaccgatttgtcttttagaaacggcagaaggcgaacaacgcttgactatgatgcaaaaatggcctgtccgtaagcctagaccgactgcagcaaagttaaatccgggtgaaccattagtcactggtcaacgggtgatcgataccttctttccggtagctaaaggtggatcggcagctgtgccgggaccttttggtgcaggaaaaaccgttgttcagcatcaaatcgcgaaatggtcggatgtcgacatcgttgtgtatgttggttgtggcgaacgcggcaatgaaatgaaagatgttatcaatgaatttccagaattgatcgatcctcacacgggtgaatcgatcatggaacgaaccgttttgattgccaatacttcaaatatgccagttgcagctcgtgaagcttcgatctatacaggaatcactattgctgaatattatcgggatatgggatacagtgtagcgatcatggcagattcgacttcacgatgggccgaagcattacgagaaatgagcggtcgtttacaagaaattcctggagatgaaggatatccagcctatttaggcagccggatcgcggaatactatgagcgtgctggtcggttccgttcgttgggatcggagcctcgagagggcagtattacagctattggtgctgtttcgccagctggaggggatatctcagaaccagttactcaaaacacgttgcggatcgtgaaagttttctgggcattagacagtatgttggcacaaaagcggcattttccttctattaattggctgaactcctattctttgtatgaagatcaaatcaattcttatttagatcagttgatgggacctcgctggtcggagatggtcaatgaagcaatggcgatcttgcaagaagaaagccgcttagaagagatcgttcagctagtgggaatggattctctctcacagaaagatcgtttgacgatgatgacggctcgttctttacgtcaagattatctgcagcagaatgcttttgatgacgtggacacctatacgtcaagaaataagcaatttaaaatgctagaaaatattttatattttgatgaacaagcaaaacgggccttgcagctaggggcgtatctggatgacataaccaaaggtaccatcgatctgcgagaacggattgcccgcagtaaatatattcctgaagaagaactgacacgtttagatgcaatcaaacaggacacgaaagcattattacaaaaaatcgtagagactggaggaattcattaatgctaaaagaatatcgaacagtctcggaaatcgctggtcctttgatggtggtagaaaatgtcaaaagcgtcaaatttgacgaacttgtccaagtgcgaatggacagtggcgaggttcgtcaagggcaggttttagaagtcagcgatgattatgccgttgtacagatttttgaaggcactagtaacctgagtgcagaagagagtaaagcccgctttttaggaacgggtttaacgcttggtgtatcgccagatatgatggggcgtgtctttgatggactaggtaagcctaaagatgatggaccgcagatcattccagaaaaacgaattgacgtcaatggtgaagccatcaatccaatggccagagattttccagatgagttcattcaaacggggatctcaacgatcgatcacttgaatacgttggtccgtggtcaaaaactgccgatcttttctgcgtcaggattgcctcataaggaaattgcagcacagatcgcccgtcaagcgactgtgccaagtcaagaaggtaactttgccatcgtttttgcggcgatcggcattcctttcgaagaagctgaattctttgtagaagagtttcgcaaaaccggtgcattggatcgctcggtattgttcatgaacttagccaatgatccagccattgagcggattgctacaccgaaaatggcattaacagcagccgagtacttagcttttgaaaaaggaatgcatgtattagttatcatgaccgacatgacaaactattgtgaagcgctgcgggaaatttcagctgctcgccgagaagttcctggcagacgcggttaccctggttatttgtacaccaacttagcgactctttatgaacgggcaggacgtttgatggataaagaaggatccgtcactcaaattccgatcttgacgatgccggatggagataagacccacccaatacccgatctaaccggctatatcacggagggacagattatcctttcccgtgatctttacaagagaaacatcaatccgccagtggatattctacctagtttgtcccgactgaaagataaaggaaccggagaaggcaagactcggcgggatcatgcggcgacgatgaaccaaatctacgcggcatattctgatgggaaggctgccaaagaactgtcgatcgtattaggggaatccgcactttcagatattgataagaaatttgctcgttttgcggatctttttgaaaaagaatacgtaaatcagggatttgataccaaccgaacgattgaagaaacattggacattggctggaaattgctcgctacattaccgaagcaagaattgagccgaatcaaagaagaatttattgaagcctatcttcctactggggaggatgtgaatccttcatggcaataatgaatgtcaatccgactcggatggaattgagtcggcttcgcaaacgcttgacgacggcaactcgggggcataagttattgaaagataaacaagatgagttggttcgccaattcattcagttagtcaaaaaaaatcaaaaattgcgccaacaaatggaatcagcgttacaagctggaatggaagagtatgttttggcatctagtagtattcctgatgtgatcttgcaagaagcttttatgattcctttgaacaaagtgacgttagatgttcaaagccgcacggtgatgaacatggaggtaccggtactcaatcctgtttatgaagaagaaagttcggatgatgatttttcatatggttttgttagtacgacaagtgagttggatctttctctgtcccatctggatcagattttgccagtcatgctgcaattagctgaaattgaaaaaacttgtcagctgatggcaaatgaaatcgaacggactcgtcggcgagtcaatgcactagaatacatgacaattccgaagttgacagaaaccatccaatacattgagagcaacttagcagaggatgaacgagcaacattgacacgcttgatgaaagtgacggatatcattgccgaaaatgaaacgcgctagacacaatgagaattcacccttttttcaactattttctgtcataaacagtaagattttttagttgagaagtcagtaaaactggtttgttttttctttgggaataacataagcttacggcagctattttcggctctttgtcaataaggactgatgggttgtacaaaatcaaatctgggtcagaatgaacctcattctggctcagattttttgttatcttactttgattaattgattgatcaaaaagattctaattctcatgttctcaaatgatttaaatccgtaggatactcgtttcattgtctttatatgggtattcttcgcttctatttttccattggtgtaaggatagatcatcgcgttggtgatgccttcttcataggtcaaaaggttttggagcttttcccgaaagccgtcatctaacgtttcgggaagttctgccaataaggagaaaaataagtcagggtctttgtctcgaaaggcttcaactaattcatgaaaatagggatacgcctccttcagggacgtagaaaagccaagcaatcgatcaatcatcatcgcttccgtaagaaatgggtattttggtgctcgaaaacttttccatgttttgtattcataatggttgatgtttgcacgattttttagcaaaaagcgccagttctttttcagtttttctgcctgacttttctgtcctactttacgaagttcattcatttcacggatacgcaactcattaaaggcttgattcatgtgtttgataatatgaaaccgatcaatcactactttcgcatttggcagaatacgtttggtaagctggaagtaggcggcgttcatgtctgtgactaaaaattttacttcttcaggattagtgcagcctaagaaatagcttgttaatcgaggcaatttacgcgtaggcaagacatcaattaattgtcctgtttcgccatctgcgcaaataaagctcattttatcttctatggaagcgtgcgaacgaaattcatcaaccatcaatactctgggggagaatcctcttagattgctttggtaagtagcttttaaactctttcaacgtacgaataacggtggtcaaagatacctgacaatttttcgcaataaaagataaagatactttttcagtcagtaaagaagcaattttatatctgacatgattcgcgattgaatgtctgggttgaacaaaataactttgagccgtccaatgggttcgacagtttttacaggtatagcgctgcttttttaagcgcataaccaaaggcatgtgattgtattgttcaaagcggacaatcgtttccttcttcccatttttcactacaattactttcccgtttccatctaccacagtagaaccacaatttctacaggtatggggagcaggtgtgaaaacagcatcgacgatcaacgtctttttcttctgaaaggtctcgtaagagacctctgtaatcatcaaatctttctctattaatcgcagcatttttttgatagaatcattcatatagcatatcgtcctctcagttgtttattttgtcgtgatttaatcatactagagaacgatatgttttttaatacctaaaataaaaatggggctgaagaatcaattctgattcatcagtcccataaattatagagccctattttcagtataaatctgaaaatagctgccgtgtttgtgttattcgtttgtaaagcgaatagctaatgatttctgcaatgtgaaagaggaggcttatttcgaacagaataggttgctatggaaagaatagcgagaaatttttcttcatgataaaatgaatgctagctatttctaaaccaaaacaaaaagtaaaagaagggataggtatcatgaatattgtggtattagcaggcggtctcagtcatgaaagagatgtatcattgtcttccggaggccaaatcgccatggctcttgaggaaagaggtcaccgagcattattgttggatttatatcaaggaaataacgagaagacatttgaatccgcttactcgattcaaaaataagaagagaatccttatgattattttgtggataagaatgaaccagatattgagaaacttatccaaaagaatagcaaccagaaaaatttgattggaaagaacgtagtagaactctgtctgaatgctgatttttgttttatcgcattgcatgggggtattggagagaacggaaaactacaggctttctttgatatttatggtattcgctactctggttctcattacaaaggcagtttattggcaatggataaagatatagctaaacaactaatgaaactgaatgacatccccacgccaaagtggcaaatctgggagcaaggacaagaagtgtattattctacaccttgtgttgttaagccaatcgataatgggtcaagcatcggagttgaaatcgttgaaaataaagaacaattttttaaggccttaaaaaaagctgaaaaatacaacagtaaagtgatgattgagcagaagatagaagggagagaattctctgtaggcgtacttggcgataatgttctgccagcgatcgaaataattccccaacaaggattttataattatgaaaataaatatcaaaaaggagcaacagaagaaataacgccagctgacatttcgagtgatttggcgacgcgattgagtgaaatgaccgtattagtgaacaaagttttgggcttatcaatttattccagagtagattatatcgttaccaaagagcttgatatttactgtattgaagccaatagtttaccggggatgacgccaaccagtttattaccacaagaagctgaagccataggaatttctttttcagaattatgtgagacaattgttgaactatcacttgaaagctggtacaaatagtcaggatgtcagcgattgattgaaggctccattaaaaaactgtgacaaaaggttcagctacactaagttcttcgaagcataatcactggataatggtatctctgatacatttttcctttggacctatagcccgcagaagtatgcttttcggatatttcgtttgttgaaagagtgatatcacagttttttatatgaaagttgatactagagattttttaaatcaagagacgtcagttgttggcaggttttggcaagcgaacgttgaaaatgatggtttcgtctttgctttctgccgagatatccccgccagatgctaacagaatctcttttgcaatcggaagaccaagaccagttccgcctgtggctgtagctcgggaagaatccatgcgatagaaaggttcaaagagacgtccgatcatctcttctggaattgtttttccacgattcgtcagccgaatgtgaatactgtctgattcgaccaattcaagaagtaaaggcgaatctggatagctgtagttgatggcattgcgaatgagattatcaaagacacgagctattttttcggtgtctactgttgcaagaacatttttttgtaagttgagttgccaatttagattcttttcttccaagagaggtaaaaactcaaaggtcagctgttcaagcattaaacttaaatcagtcgtttctgtctgcaaaacgatcgtggtcaaattgaagcgtgtgatctcgaagaattcactgatcaatagttccagccgttgggctttttgtaaagcaatctccgtgtaacgattccgcatcgcattggataattgtggttcttcttttagaagagtcagataacctatgacacttgtcagaggcgtccgcaaatcgtgggcgagataaacgatcaaatcatttttccgctgttccgcttctttagcggcacgttgatcttgcagacttttctcccgcagttgattcatttcctcttgaacatcaatcagatggctcgataaagtgatgcgtttggatggttcttctatcagttgagtcgtggcttggatcgtttcattcaaataaccgatggctttggtcatatagtaaatggtggtaccaaaccatatcagtaaagcgccaatcgcaacacaaaacaaccagcgatccgcaaaaaaacgtaagatatagtagataggttccgttccataccaagtccgggttccggcaataaagcgaatgactaatggaatcattacaaggaatgccagcaagattccagtggtgacgaagtattgggtcaagagctttcggatcaaaggatttctattgttcaatgatatagccgaccccccatacggttttgattaatttaggtttacgaggttcttcatgcaatttttctcttaaacgagcaatgtgtgccatgacagtattattgttatctaaatatttttctttccaaaccgcttcgaaaagtgtttcggaagagacgacggatccttggtgctcaaataaataaagcaatattttgaactcaatgggagtcaggaaaacttctttgccgtagagaatgcattgatgactgttgattttgagtatcaagccgtctttttcatattcttctactgttggagaagcagtggaatgattgtatcgctggtagcgccgcaattgggtttttacccgagccacaacttctaaaggattaaaaggtttggtgacatagtcatccgctcccaaactcaatccagtgattttgtctagatcctctcccttggcagtcagcatcaacactgggaaaaaatgggtcttgcggatctgctgtaacagttgaaaaccatcaatgtccggcaacatgacatctaaaacggccaaatcaatggcttctttttcaatataggcgatggcactagtaccatcataaaacggctgcacactaaatccttcgttttgcaaaaaggtcgtgactaagtccgcaatttctttttcatcatcaacaacgactattttttctgacatactctctcactccacctaaacatagtttcggattctcacatttccatacccccatcataccttacctggtaaacttatgcatcgttttctatttgatcctagcactgactcgtggaccgatccgacaaatcaactcattggttatagtttgtacttgctcggcagtatcgctccaatctgtcagaatttcaatttcactttcaattgggatcgtaggacaatggctcaagtctatcaaaagcatgtccatgcagatcaagccgatctgcggcaaggactgaccgcgataggaaagacaaaactcttgatttgatagagaacggggcagtccgtcacaatagccgatgctcacaacaccaacagttgtttcttgattcgcgacggcggtttgcccataaccgatcgcttcccctttggcaacgactcgcttagtgatcaactgtgctttgagggtcagaataggctgtaagcttactcgttgttttgtaggctcgttcgtatcactgagggatcctgtcaataaaatccccggacgcacataatcatagtttaagtctggataattcaaaataccataactgctttgtaagtgtgtgataccataagaaatctgtctctgatccaactctaggagaatctgatcgaagcaggcaatctgcttctgagtgcgaatcatactatcaggatttaagcgatctgccgaaccaagatgagaataaacaccactgatcgtcaagaagggcaaatcgaaaatcgaaagaatcgaatcgatagtcggtgttacacctaaccgatgcatcccagtatcgatggctaaatgacagtcaatcgctacttttctttgtgacaatgctacagcatgaccttcgctgatgatcgattgggtcaatgagtagcgacgaagttcttttatgcgttttggagaggtatatcccaagaccaagatggggcttttgacagcatttttccgcaatcgaataccttcatcaatcgtagccaccgcaaaaaaatcaattccggcttgttctaaaacaggagcaacttccttggcaccacagccgtaggcatcggctttaacgactgccatcacttttgttttcggtgagatgatccgctggatctcctgtagattatgcaaaagggctgtctttgagaattcttttacggcccttttaacgggcgttgtttgtttgtgtctaaaccatgagtgtttttgtcttaaaaagaggcaaatgaatccaatcgtcaagatcaaaacaaccaaatagttgattagattgttttgcagaatgctgattttttggctcaaaaagtgtgtgccggcaattgtataaggatgtaaaaggtaaagccacaaagatagctgtcctggatgcttccaagtcctgtggggatgccagcgcaagatcagcggaaataagaaaaagagtacaacaggcaagaagagatacatactgtcatgtttaggtatagaaaacccatgcaagtacgcactctcaataagcaatccgataagactgatcaaaaagaagagagctgttttggataaacttcttttctctgattgttttctgaccagcacacctaagcacaaaaacaatggtgtaaagaaaataccgttgcgggtaccatctaataggtggaacacagcagtatagaatggttcgattggtgtctgttggatcagtccaaaccaactatcaccacctaatccaatcaggtacaatccagccgcaagccagaacacttttttgaaggagacatgtatcagcaaacttgttaggagcaggctcccagtaatcaaagccggaaagtaccaaagatgataaagaatgccattgaccaaaagtgcttgtactaatgttccaactggtagatcgaagccgatcgtttgactatagagtgctaatggtaaaaacattagtgtggctaatagatagacttttagctgttttttgataaagttgaatactcgttgtcgcgaaggataactattggccacagcaagttctgcaaacacatagtaaccactgatcataaaaaagaaaggaacagctactcgaaaaatcgtcaatgtgattaggatatcgccttctggccataaatagtgaaggggaagacaatggatcgcaaccaccatcatggctgcaatcacacgaaattgatcgattcctttatttttcatgcgaactgcctcactgtctgagccaagtaatcatggtattcttccagagtccatttttgggcagtgatgacttggctatggggaagcccgacataacgaaaatgccaaggttcataactgataccggtgatctcttgtttatcttccggatagcgtagaataaagccataattcatcatctgctgcataaataaatcagcagcagcactatctcgaaaatgagggcagataagatcatcatcttcttgtttctttagtcctacatcaatggccagaccgatttgatgttcactgcaacctggcaaagcaacgaattgtttggtataagctaacccgttttcttttagagaatactcccacaagcgtcgctgttctttttccgtacgatacccatctaccagacgaatgtccttttctagtccggttgctcgtacgagtcgttcccattgttttgccacttctggctgcaagtaaacatcgtgatcgctaaaaggagctagcactaagtgcgggggctcttgattttttttcaatggatggtttttattgatcaattgtaatgtgttcatcgtttgtcctcctctgccagtgcaatcaattgctctactaatatttcgtaggataacccgacttccgccatcatagctgggtagcgggagtgcccagtaaatcccggcatggtgttgatttcgtttaaataaatcgctccttgattggtgacgaaaaaatcgattcgagccagacccgtcaatcccaagtttcgataaagcagctgtgcctgctccttgatctgtgattcaagcgcgagaggcaatggtgctgggacagtgatcgtggcgctgattaattggtatttctcttcaaaatcaaaaaaaccgtcgacaagagaaatcgcatcacaagcaccaatcgtcaattgctcatttcctaagatgccgcagccaatttcaatacccgctatcgccttttggatcaacacagtagaaccgtaagcaaaagcagtcgttaatgcagattggagcgctgttttgtcagttacttttgtgatcccttttgaagaaccggcttcattcggcttgataaagatcgggaatccatggtcttgaataaaacgatcgattgtggcaggatcgttttcatagcgggataaaagcaaagtgggagcactagcgattcccatggtatcagcaagttgatgcaagagccatttgttcatacataatgcggaggcagcgacatggcaaccaacataaggcaggttcattagttcaagcagtccttggatacagccatcctcgccatacttcccatgcaagactggaaagaggacatcagggacgattcgtttttctcctaatataaatccttggctagaaaaagtcagctggtgacagtttttgtgatcttctagccaagtatcattgcgaacattcgcgaggtttccttgataccaataccaatccattgttggtgcgatgccaatggtcattacttcatatttcagcgggtcaatagcttggatcacacttgctgctgaggctagtgacactgagtattctggagaattccctccaaataaaacggcaatttttttcatcattttcttcctttccttttttcttttaaggttacattcagtgtacctaggaaaagaaaagaaaatttgcggtcttcctgttgtctttctcgtatttttatgatgaaaatctaacgattttatgacaaagggcttgaagaaagcaggggaagctattgttagtgatcaaatggacaacaactcttggtacagaagtgcgttgaaggaagagctcacgcatgcaggaaagcgtacaaaaaaggaaccgagctgaactattttcaacttggttcctctgtattcatacgttagttctttggcgtagtgtgatgtgcccaattgaggcagctatagctaaagaagatacagttaagtgtgcaacagtagctgatcatcttttagctcagtcccactattttgatggaagagtgccatcaaatccggtaccgttaaggattgtttttcctcacctgcgatatcgacaacgattttgccttgatggagcatgatcaagcgattgccgtaacggatggcatcttccatatcatgagtgaccataaatgccgtcaactgctgttcttgaatcaactgatcagtcagtgccatcacagtcatggaggttttcggatctaaagctgcagtatgttcgtctagcaggatcagtttaggctgttgcaaggtcgccatcaatagtgtgatcgcttgccgctgtcctccggaaagcagcccaatctcagtcgtcagtcgattttcaagaccaagattcaagcgagctaacttttctttgaagaaggcccgatgctttcctttgacaccggaggaaaacccgcgaacctggcctcttttataagcaagggctaagttttcttcgactgtcaaacgaacggctgtccccatccgcgggtcttggaagacacgactgatttctttggagcgtcgtgtgactgaatgacgtgtgatttctttgtcacctaagacgatcttaccttgttctgttgggatcgttccagcaatactattgagtaatgttgattttcctgcaccgtttccaccgataatcgtaatgaaatcaccgctgttcatagtgagatcgatcccgcgaaggacatgattttcgttgatggttcctttttcaaatgtttggtgtaaatcactgatcgttaaaacaggtgtcgtcatgattgacctcctttggttttcggaagaaatttttgcaatccaagtttcgttcgaatttgcggcaatgaaagacagataaccaaaacgatggcagaggcaagttttgaatctgaagcttccacgttgaattcaaagacgatggccaggattagacgatacaaaatcgcaccaatcacaatcgtgatcaaacgaacccacaaagatttattgctgaaaaggacttccgcgataatgatcgatgctaatccgatcacgatcgttcctacacctgagttaagatcagcaaaaccattgttttgagctaagagggaaccagaaagagcaatacagccattggaaatcatatagccaattagtttcatattgtccgtattaattccgttggcttcactcatcgcgagattgtctcccgttgctcgcactgctagtccaatctctgtgcggaagaagagaaacagcaacaaaatcacgacagcagcaaacaggaggcctgtacaaatgactgcggtatttttcgttaagcctagtgtttgaaaccaagtaaaaacagtatcttcccctaacaaggcaatattgggtgcccccatgatccgatttgtaatagaatacaatccagtcatggtaatgattcccgctaataatgcgggaattttaaatttggtatgcaagatccctgagacaaatccggcagctaaaccgccgcaaaagcccaacagacttgccgtaaaaggggaaaggccattggtgatgctgacagcagcaatgccggctcctaatggaaagcttccctcagctgtcaaatcggcaatatctaagattcggaaggtcaaataaaccccgatcgctaataatgcccacaacataccttgagaggcagctgattgaataagtatgaaaaatgtattgattaaattcataaggtttcctcaaatcatttttaggtttttagtttcaagttagttttcatcatttcatcatatagcagcaaaattatagtagatagtagatagtagcaaaattactcaggagccacgatgctttctggatcaattcctaatgcagttgccattttctggttcacaactagctctagtttattcgctgtttctacaggtgttgtagcgggcttttcatctccatcaagaatttttgcagccaattcacccgtttgtttgcctagtgacttgtaatcgatcccgaatgtagctaaagcgccatcttccacttgctcgacagaaccagcaacgatcggtgttttggtttctttggctacttcaccaacgactgccgcagcagaagcaaaggtattatctgttggcacgtagataccatccacatctttagctaaactagtagttacttgttggacatcatttgtcgtgtttgctgtcaagactttgacgtctacacctgcatctttcaatgctttttctgccaaatctgcttggatttttgaatttgcttctccagcattatacataataccgattgttttagcgtcagggacgatactcaataacaattgaatctgtttatcgatagggaccatgtcagatgtaccagtgatattgcgtccaggagcttcattggactccgctaattttgcttcaactaaatcagtgactgcagttacaacgatcggaatatctgttgtttcattcgccaatgagacagcagctggtgtcgcgatccctaagagaagatcaggagaattttttacaagtttttcgctcatactcttcagattgtcttggctgttttgggcattttggtattctaaagtaaggttttcgccttctttatagccgccttccgccaaaccttctttgaatccttcataggcagcatctaacgaaccatgttccaccagctgcaagataccaaccgtttttttgccatcttcagtggcattgttggtattcccgcatgccgcaagtccaagtcctaaggtagttgccaataggccagttgtgatccattttttcattttcatcaaatattcctcctaaaaagtcttgatttaaacccaacggaacaaaaaaatccattcagacaatcgtctaaatggatttgaacttaccaaaattcagaaattcagtgcggccatttagaagattctctacatggctgctgttcacgttaaactgctctagccattatagatacaaacaaagtgttgtgaggtttgtatccacaatgttatgaatacaaactatctaaaatagctaaagtaagcaatattcagttgtggggatagcaataatttcatgattcttcctccaaacttgaattgttttcagtatagacgaaagttctaccatctgtcaattgaaaaacgcaatattctgaaaattttttttataacagataaagagatgtatgcaaatagtaaaataaaataaaaaagcagccagattaactaagctgctttgattaaataggtttagctttctttataataacggatcgtatttttaatttctcgaatactataaggaagatcatcagaaaaagcggcatcttgatcgatttccaatgaatcagtaaagatggcttcatattcctcaatacttaatttttgtcgctgatccaatagctgagtgtgggcttctttgtttaattgattttcataaccagctaccaaacgaccactgaaaaattcagaaacagccccagaaccataactaaaaagaccaatgcgatctcctgcgcttaaatgagacgaattttctaataacgaaatcagtcccaaatacagagagccggtatagagattgccgattctgcgactatagacgatggattcttcatagcgagccatcactcgttcctgctccgtttctacttcatcggcaaagactgctaacaatgcttttttccccatttttgtataaggaatatggaagctgattgcagcataatcgctgatgctggcttgattgcgttcacaatgagcttgccacacttttttgaaagaatcgatgtaaacttggttagatagatgcccatcgaccattggataagcgtggccgagaggacgccaaaaatcataaatatcttgagtcaacatcaaattgtcattttcaaaagttagaattcgtgggttagctgtaagcaacatggcaacagcacctgctccttgtgttggttcaccaccggaacgtaaaccataacgagcaatatcggacgcaatgactagaaccttgctttctggattggcttgaatatgggttttcgcaaattgaatccctgcggttgctccgtaacaagcctctttgatttcgaaagagcgggcgaaaggttggacgccaagcaatctgtgtaagactacagcagaggctttcgactcatcgattccagattctgtaccgacaatcaccatgtcgattgcctgcaaatcttcaggttctaagatttcttttgctgcactagccgcaaatgtaacgatatcgtgtgtttttttgctgactgccatttggtcttgaccgataccaatggtaaatttattaggatctacctcacgagcgtgagcgagatcaaccatgtctaaatagtaaggcggaacaaaaaaatttattttatcaataccaacgttcattatgacgctcctttgggtttaacttatgttataactatcgtttatacggtatcatatttttgtttaaaaatgaaaaaaattctattagaatttaaactttatttaagaatggctgattggaacagaatgcaaactcgtggggtattctttttttgtggaaataatgatatatttctgttggaggtggcatggtggaagaagttgttattatcgatgcacgaagaactcccatcggtaaataccatgggtcattaaagaaattttcagcagttgcattaggtactgctgtagcgaaagatatgtttgaacgaaatcaaaagatcaaggaagaaatcgcgcaagtgatcatcggcaatgtcctacaagcaggtaatggccaaaaccctgcccgacaagtggccctacaaagtggtctctcagtggacatcccggcatcaacgatcaatgaagtttgtggttctggattgaaagccattttaatgggaatggagcaaatccagttgggcaaagcgcaagttgttttagccggggggatcgaaagcatgacgaatgctccgtccctcagtcattacaataaagcagaagatacttacagtgtcccagtctcaagtatgacattagatggcttaacagatgcttttagtactaagccaatgggcttgacagctgaaaatgtggcgcaacgctatgacatctcacgagaggctcaggaccagtttgcctatcagtcacaaatgaaagctgctaaagcgcaagcagagaataaatttgcgaaagagatcgttccgctggctggcgaaacaaaaacgatcaccgcagatgaagggatccgcagtcagaccacaatggaaaaactggcttctttaaaaccagtttttaaaactgacggtaccgtaactgctggaaatgcttctacgatcaatgatgctgcagcattggtgttgttagcatcaaaaacctactgtgaaacaaatgatattccgtatttagcgacgatcaaagagatcgttgaagtagggattgatcctgaaatcatggggatctcgcctatcaaggcaattcaaacacttcttcaaaatcaaaaagtttcattagaagacatcggtgtgtttgagatcaacgaagcatttgctgcatcttcgatcgtggtggagtctgaattgggattggatccagcaaaagtcaatcgctatggtggcggaatttctcttggacatgcgattggtgccacaggagcccgcttagcaacttctttggtctaccaaatgcaagagatccaagcccgttatgggattgcttctttatgtgttggtggcgggttagggctggctatgttgttggagcggccaacaattgaaaaagcaaagccgacggacaagaaattttatgagttgtcccccgctgagcggttacaagagcttgagaatcaacaaaaaatttctagtgaaacaaaacaacaactgtcacaaatgatgttagcggaagacacggcgaaccatttgattgagaaccaaatcagtgagatcgagctgccaatgggtgtaggcatgaatctgaaggtggacggcaaagcatatgtcgtaccaatggctacagaagaaccttctgtgattgcagcaatgagtaatggagccaaaatggctggtgagatccatacgcaaagcaaagaacgattgttgcggggacagattgttttttctgcaaagaatccaaatgagatcgagcaacggattgcggaaaaccaagctttgatttttgaacgggcagaacaaagctatccttcgatcgtcaaacgagaaggaggattgcggcgcatcgctctgcggcactttccagcagattctcagcaggaatctgctgatcagtcgacgtttttatcggtggatcttttcgtggatgtcaaggatgcgatgggagccaatatcatcaatgcgatcttagaaggcgttgccgcacttttcagagaatggtttcctaatgaagaaatcttatttagtattttaagcaatcttgctactgagtcattagtcacggctgtttgtgaagtaccgttttccgctttgagcaaaagaggtggcgccacggttgcacaaaaaattgttcaagcttctttgtttgccaaaacggatccttatcgagcagtcactcataataaaggcatcatgaatggggtggaggcagtgatgctggccactggaaatgatacccgggcagtttctgctgcctgccacggctatgcagcacgtactggcagctatcaaggactgactaattggaccatcgaatcagatcgattagtaggggaaatcacgttgccgttagctatcgctactgttggtggtgccacaaaggtcctaccaaaagcacaagcagcattggaaatcagtgatgttcactcttctcaagagttagctgcgctagctgcaagtgtgggacttgtccaaaacttggcagctttgcgggcgcttgtctcagaagggattcagaagggacatatgagtatgcaagctcgttcactagcgatcgctgttggagcggagaaagcggaaatcgagcaagtagctgaaaaactacggcaaaatcctccaatgaatcaacaacaagcgttacggtttttaggagaaattcgggaacaataaaaaacttgtttcaacggtagcaaatgctactgttgaaacaagtttttttgtcatagacaaattgatgagtgtttctagaagctgctaaagctcatctttttaagtacatcccaatacttttgggggctgtctccacaaagccaaactgctgataaagattttcagctggacaatcagcaatcaggttcacgtaagcttggggatctacttcattatgtatatggttcattatggcgctcatgattgattttgccaatccattgccttgatcttcaggaaggacagcgatgtctaggatttgataggcagtacctctgtcaccaatcaatcggcccatgccgactaaggtttgatcgctggttcttcgaacagtcactgcaaaaagactattgcttaaaccaatcttactcgcagctgttccacgaagagaaagaccgcaggcttttcgtagagttaggtattcagctacttcaggaactgtatgttttaggagatatttagaatcgttcatcatggtcctccttgatacagagtagagttgtttagtcctagggaatttgatcaataccctttagcagatggctttttggtaatgggcaaagacgtctttaaaagaaagagacgatgatagaaggattccaacaaatgaaacagccaaaccccaacagttgagctgttcgtttttttctatcatcgtctctttagcttaacgttcagttagtggggtattcgcatactcttcgatcaatggaatcacatccagcttcagtttgtacttacgagctaaggcaggttcaacagtgaattcgccaacttcagtcgctgatatagttgccaataggcgtttttctttcgctgtatcttcaaaaatctgcacattctcggcatttctttcaacagagaatttaggaaatgcagtcattttttcttcaaaagcggcaaaaccatccgttgtttccgctgcttccgtctgagattctgagactggttcggtagcagaggcttctggttgattgacagctgatgttgctggtaaccaataagcggcgatttcttccactagattatcactaaaacgatctaatagacctttttcttgtttttggattcgtttcacaacgattttgaaattctcgtctaaaggaactgcgattttttgttctttggtcgttgccgtttgcagttcaatcaacatttcctcacggtttttagggttgatataaacggtggtctctagtccaaaatttgcagctgtcttgtgttggatcgctgaaaataattgttgacgtgccatttcataagatggccgaaattgttgttttaacttggctaattgtttctttttcatattcttctcctctcaatcaatctcgattataaggaataatgacgaaaatgaacaggggttttcatgaaaaaatgaggaatttcttttgattatcagaaaaaatggcctttctttaaatgaaataaaagaaacagccaagatcatacccaatgagtaggggatgactttgactgtttctgagggcaacaacttacttctaaagatataccaggttcatcgcatagtgctcaaagcgtcgatttgctgatatttaggcatcaaaataaacgaatcatttttaccataggcgaccaagcaattttcccatagaaaaaagcttagcggcatcttcgctttttcagcaagcatttgctgatagtctgactgatcccattgacgtgcgggaaaatgttgaacgtagtcgggaaaaatcagaaatacaaaatcaggatgcaaggctcgcttgacggcagtgggcagttgatccaaacgtgtagaatccatcgggttttccctcattagaatcctgttgtatccggattagttgctttcccaacgactccatctagttggtcgattcgctgcatatcttcatcagaaagctcaaaatcaaagactgctaagttttcctcgatacgacttggtgtaacagatttaggcagcggcaagaaaccatgttgtaaagaccagcgaatcgcgatttgagcaatcgttttgccgtacttgtcagagagttcctgcatttcaggaacgtcaaagatctttcctgtgcctaaaggactgtaagcttccaataagacattgtgctcttggcaataagacactacttctttttgtaattcaccaggcgctaagaaaatctggttgaccattgggaaaatagtggctgtttttttcagttcttcgaaatgatgaggcaagaaattgctgacgccgatggctttgatcttcccagcttgataaagctcttccatcgcgcgccatgtctctgcatttgctgactgccaattgtcacggaatttcactggatttggccaatgaatcaagaaaagatcgatatagtcggtttgtaatttcttcaacgattcttcaaaggaagaaaggaccaagtcgtaagagtgattttcattccataattttgttgtcaaaaagatttcttctctaggaatgccactttctttaattgcttgtccaacactgtcttcatttttgtaaccttgcgcggtatcgatatgacggtaaccaacttccaatgcttttttgacagcagaaacagcaacgtcaccatttggtgtttgccaagtgccaaagccaagttcaggaatcgatacattgttcgataaagtataactgttcattttcattcctccatttctttgtttttagtttagcagagaagggatttttttccaatggaagatacttctgatcaaaataatgcacaaaaaagatgtaaaaaaacttgtgttttgaaccagtttttttgtacacttgagaaatggataaggagagagaatatggatatctatttaaagcgtgcgattatgcacattgtggatcgacaaacgggtgatcccgtatactcgcaagtggaattggatctgacaacggaatacatccgagattatttaacgaaaaaaattcaaaaattagcgacacctcagacaaagaccggccgcttgctggaggactctgagatggctagattcgtcaaacaagcgccggaagcatttgtagaaagcagtgaagcaatcctgcgacgctggtatgaagtttaccaacaaagtgaagatgcaccaagtgcggatgctttcattgttttgtatgaattagataccaaactgcaattagcatttttgaaggttaattatacagatggctacacgcactttatcgacagtactgaaacaggtatcgccaataatctgattttgcatcgagcacttttagctggcaaaacccaaaaagcagatgaaggaataacgatcgatgtcgagcagctgacttacgaattagtagagaaaaaatataccttctccggagaaaaatatttctatttctccacgaaagtgattgattctgaaccgctgccttctctagaagaaaatgtcaaagtcatcaaaaaggtagctgaaaaaattggtcaaaagtttgagaccccttcttatgatgtcatcgccgatgtcaaagaggctgtttacgatacaatagaagaaaatggtcagctgcatgtagattcgattgcccaaaaagtattcaaagataatattacggctcagatggcctttcaagaagaagtagcagaaaaagggtatatcgatcaagcccctatgctgcgagaggtcagagaaatttcagaaaaaaaatatggcaaacaaaagctaaaactttccaatggtatcgagttgatcgttccattggatgtctatcgagatcctaatttgatcgaattcatcaacaatcccgatggcacgatttctgtaaccatcaaaaatgtggaagaagtcatcaatcgcatataaaaatagctgccaggctcttctcaaggagtctctggcagctatttttatttattgttgagttgatccaaagcgggtttgggtacatcttcttgtgagacttcttcccaactgaggacacctttgcggggattgactaatagtttcagataagctccttctcgtaggggcttggagcggtgttcattcattttaacgatcttctcttcacctgattcattataagccgcttgttcatatttataaatatcttgagccacaccatcactggcaattgatgttgagtgggtaccgctggtagtgatttcggtgtagtaagcagtgccgccatagtaataacggtaggcaaagaaacagccgcctaagaaaacgccaaagacgatcaaactcgcaatgatttttttcattcctgttcacctcatatctattattctataaaaaagcagacccgtccaactattttatcaaaatcaaagcaaatcttagaaattttgaataaaaacggcgaacaatgaaggagacaatattcttgactttgactaaatttgacctataatagagataggtttaaacttacaaaaaataagtaagaaagaattttttacttttgtaaggaaaagtctataattgatagtagagccgatccaacggcgctacatctcatttaggagggaaattattatggcaaaacaacattatgatcgtagtaaaccacatgtaaacattggtacaattggacacgtggatcatgggaaaacgacactgactgctgccattacgacagttcttggtaaaaaaggactcgctaatccgcaagattacgcaagtattgatgcggctcctgaagaacgggaacgtggtatcacgatcaataccgctcacgttgaatatgaaacagaaaaacgtcactatgctcacattgatgctccaggacacgcggattatgttaaaaatatgattaccggtgctgcccaaatggatggtgcgattttagttgtatccgcaacagatggtccaatgcctcaaactcgggaacatatcttgctttcgagacaagttggtgtgaaacatctgattgttttcttgaacaaaatcgatttagtcgatgacgaagaattgatcgatttagtggaaatggaagtaagagaactactatctgaatataattttccaggtgatgacattcctgttatcaaaggttcggcattaaaagcgttggaaggagaccctgatgcagaagctgccatcatggaattaatggatacagtagatagctatatcccaacaccagagcgggatacagacaaaccattactcttaccagttgaagatgtcttttcgattactggacgaggaacagttgcctccggacggatcgatcggggaacagttcgggtaggcgatgaagtagaaatcgtcggtatcaaacctgaaactcaaaaagctgtagtgacaggcgtcgaaatgttccgcaagacgatggactttggggaagccggcgacaatgtaggtgtcttgctaagagggatcactcgtgacgaaatcgaacgcggacaagtattggctaaaccaggttcgatcacaccacatacaaaattccaagcagaagtttatgtattgacgaaagaagaaggtggtcgtcatacaccattcttcaacaactatcgtccacaattttatttccgtacaacggatgtgacagggaacattacattgcctgaaggaacagaaatggtgatgccaggtgacaacgtgaccatcgatgtggaattgattcatccaatcgccgttgaaaatgggacgacgttctctattcgtgaaggtggccgcacagttggttccggtatcgttactgaaatcgaaaaataaatcagtgtttcaacaaaaatgaagcagtgactagagccttttaggacagtcactgtttctttttctaaatttctttgtgattttattaaggattttagatgatggaaaacaaacctagtcagcaaataagtttcatagtaggatagaagctgacactaaaaagataggatgtttttccatgagaaaactgcgacgattttttatttttatagcaaaaatagctggagtcctgttgcttatcggcggactgtttttaggctataaaaattatacagctctaaagaaagtgtattcttatgaagaaacaatcgctgagcaaacagaaaaatatggcatcagcgactatcaggaattagcgatgagtattatgttgactgaatcaaaaggggaaggaaacgacccgatgcaaagctcagagagtgcttacgggaaacaaaatcaatttgaaaatgcccaagacagtatcgagcaaggagtggcttatctggctaaactgatcaaaaaatctgctgacatgaactgtgatctgtggaccgccgttcaagcctataattttgggacagactatattgattatgtagccaagaatggtggcgaaaatacgctagaactggcagagtcctattcaaaagaagtgctttctcctttgttaggaaatgataatgagcaaacctatcgttactgggggtggcagtcgatcacttataatggcggttatttgtatcacaatggtggcaatttattttatgcagatgtggtaaaattcaatcaatggaagataaaaatgggtagtattttgttttcttgaaagtctctgaaatcaagcaggtaaaagacttgaaaaaacaataaaatatgatagaatcaatatgagtgattctgtctaattattcgtcgcactgattctgattggtgcgattttttacctaatgaatacgggaatacttaccgaatggaggtgagtggatggcacgaatacctcaaacggtcattgatgatattcgagaacgaagcaatatcgttgatatcgttggtcagtacgtccagttgaagaaatctgggaaaaactattttggattatgtcccttccacaacgaaaagtcaccttctttttctgtggcagaagacaagcagatctaccattgttttggctgtggccgcggaggcaatgtctttggttttttgcaagagttagaaggattaagttttccagaatctgttttgaaagttgcagaaatcagtgatatccctttagatgagcaatacaagcaaaccgaagcaattgatgcaacctcttctcagcaaaatcaattgatcgcgttgcatgaaaaagctgctgaagtctatcatcacatgttagtcaatacggctgccgggcaaggcgcattggattatttgctggaacgcggattgacgatggcactgattgacgaatttcagattggttttgcgcctaacgagcgtgcctttttggaaaaagtttttttgaatgaaaaagcaaatgcggcattttttgcggatacaggtctctttgtacaaaggaacgatgggcaacttgctgaccgtttttatcaaagaatcatgtttccgattcggaaccctcaaggaaagaccatcggtttttctggacgctggtttcaaacggaacaggatgatagcaaagaccagcccaagtatttgaacagtccggaaacaatgcttttcaataagcgtgaagtacttttcaactttgataaagcccggcgatcaatccgaaaagaaggccaagtctttctatttgaaggctttatggatgtaatcgcagcgtggcaatcaggaattgagaacgggatcgcttcaatgggaactagtttgacgaaccagcagattgccaatattgaacgtgtcgctacagaagtcatcctttgctatgatggtgaccaggcaggaatcaatgcaacgaatcgcgggattgatcttttacaagaacatagccgcgtgaatctctccgtcgttcgagtccctgaacgtctggacccggatgattatgtgcgaaagtatggtacagaggcctttttcaaactggccatgcatggcagagaaacggtgtttgcattcaaaatggactttcatcgtgccaatcgcaatttggccaatgaaaaagaacagatcgattatgtccaagaggtcttgcaagaattacagcatgtagattctttgctagaacaagaccgatacttgacacaactttcaactgaatttcatattagtcgagaaacactacagacgcaattgcgtcagttaaaacagacgcagccgaccccaacgccttcaccgccagttcgtgaagcagtgagtgtagcaccaccgccaccacgacagcaacggaaaactcaggtagaaaaggcggaggaattactgttatatcgtctgttccatgacaatacgctgaatcctcgttttaaaagtaccggtgttgcgtttattcatgataaataccaacaaatctattttttatacgatgcgtatatggaaaccgaagagcaatttatcctagcaaaattcttggattttttgaaagatgaacaaatgaaacaacaagtgatcgagatcgctgatatcaaggcttctgaagaggggacggaacaagaattccaagaccttctgcaggtatttcgtaagtcgggcattgctgaagaaatcaatcaaaaacgaatccagcagcaagaagcacgacaaaaaggaaaccagcaattagagttggaattagcaattgcgatcattgatttgaccaaacggttgaaacaagctaaatagcgaactgaaaggggctttctttcatggcagaagaaacaaagaaaacatatgacaaagctgttgccgaatttatcaaagaaaacaaaccaaaaggacaagtcgtttatgacgaactaaccaatcatttagcgaccccttattctttagatgcagacgcaatggacaagctgatccaaaaactggaagactcagggatcagtgtagtagatgagaatggggagccttccgttcatagtttgaagagcaatgaaaagcagcaagcaacgcaaccacaagaagatctttccgctcctacgggtgtcaagatcaatgatccggtacggatgtatttgaaagaaatcggacgcgtacccttattgactgccgaagaagaagtagcccttgctttaaaaatcgaagaaggcgaccaagaagcgaaacaacggttagctgaagccaacttacgtctcgttgtaagtattgcgaaacgttacgttggtcgggggatgcagtttttggacttgatccaagaaggaaacatgggcttgatgaaagctgttgaaaaattcgattaccgcaaaggattcaagttctcgacttatgccacttggtggattcgtcaagcaatcactcgtgctattgccgaccaagcacggacgattcggattccagtccatatggtggaaacaatcaataaattgattcgaatccaacggcaattactgcaagatctaggtcgcgaaccgacaccggaagaaatcggagcagaaatggatctgccaactgaaaaagtacgtgaaatcttgaaaatcgcacaagagccagtttcattggaaacaccgatcggtgaagaggatgattcccatctaggcgattttatcgaagatcaagatgcgacaagtcccgccgaacatgcagcctacgaattgttgaaagaacaactggaagacgtactagatacgttgaccgatcgtgaagaaaatgttttgcgattgcgttttggtatcgatgatggtcggacacgtactttagaagaagtcggaaaagtttttggtgtaacgagagaacggattcgtcagatcgaagcaaaagcgttacgtaaattacgccatccatcccgctcaaaacaattaaaagattttctagaataaaactgagaccacaaagacttttccaagaagtatgcttggagaagtctttttcttgtggtttagccaactttcgtaggaaaagtaatgaacttaataaaaacgtaacgaagcaagtgttggctaattgctttgaatatgataaatttaattttgtgaatcatttacacgaaggtgaatcattttggtacagagagttttttcaccaaagccagtgaataaagggcaagtctataagtgtgatattctgtagtaaaatgaaacctttcaacgatgaacagatacctgccgaagcaggttcaaaataaaaggagcaaattcgaacaaatgatgaaaacatgtcctcaatgtggatttgaatcaattgatgcacaaaagaaatgtccaaactgcggctttgagtttgttaagtcggatgaggcaaatgaaaaagaagcccctcatacgaatgagacggtatccgaaaagaatccgcagcaaaatgatgatatccgctggtctgattttaaggatgttcccttaggtgaattaattgaacatttcgaagacaagaatgaaactgatgagtcaaagaacaatcagtcagaagacgacgtaaacgtgcaagagctgataacgaacccaaatatagaacagacacccgtttcaaaagaaacgctatcagatgcgtccgaaacgatcgaatcacagtcacttgaatatcagtcagcagaacaatcgatgcacagtggaaatgaaagcaatgaagtgtctggatcagacaaaggaatccaatcgatcgcagaaagttccgcagagcccaatgatttagtagattcagccgaggtccctgaagatcacgattcggctattttatctgcttatattcgtcaacataaaaattcagagatggatgaagatgcgacagatgttccagtgataccggaagtcacggacgataaagaggctcttcctctaacggaggaacaatctcaatctggattagaagatgaacaaactgatactgcagcgattactgaatcttcagaaagccctcaatcaacagagagtccgcaaccgaaaattgaagcagaagaaacaaagcttgccgaaattccagaaaaaacagcggtatctgaaaatacgaagagtaaaaccgatccactgcccaaaaataaaaagtcacgcaaaaaattctatgtagcggctgcggcgttggtacttgtttctgcaggtggctggtattattacgaagagaccgctcgtcaagaacaaattgcgacagcaagtgagctggaccagatcgaagcggatctagccgatttttataccgacgataaccaagaatttatcaaagcagacaaaacaactacgcaattgacggcattgactgatcgactagccaagtataaaacggaaagccgttacccggacttgttggctcagtctgaaacaatcaaagaaaagatggcgactctttcggaaatcaatgggtatttcactagtccagtgatcattgaagatcaattgcagaaggtttccttaaaagagccttcggcagtgactatgtcaaaaagaacagctgaaacaccattcgatcaattagtaaatcgggcgattgatcaagggcaaaaagagtatgcccagatcgaagaagtacgaaatgcagtcaaaagcatggttgctttgaataaagagggtgaactttctgacaaagtcacgcgaaaaagctacaatgatttagtgaagaagatcgatgcattgtcgattgcttctttaaaagagcaattgactgctgagatagcaccgattgattctgcactgaagaaaaaagaagctgctgagaaggctgctaaagagaaggcggcccaagaagcagctcaggcacaagcggaaaaagccgccgcagctcaagaaacaactacggctaacaatagccagtcttctgaagctgattatgtattatcgccgaatacaccaacgaataccaataatcaaccaatcattccagcacgtgaaagtgatttggcagactctagcaatccggcttggaattgggcgcctggtgtccaagaaaagatcattgcaaccgcaattgctcgcggctatgtcgttgaagggggttatacctttgagcgcgtacgaatcgtgaatggagaaggttactataatttttatgcgaccaacaaccaaggctccttgttgaaaggaaccggtgattccgcttttccaatgtatctctttacagtgaatgccaaaaccgggtatttccgtggaaatggaaatgatcatacgattcggtgatgggtgacacttagaaaattttcagcataattacattattgaatcaaaaaacagcttgtttctcctccggcttttcgatatgatggatgataatcaatcggaaacggaggtttttttgttgcagaaaattgaaagatatgaacagttcagtgatggagttattgcctgtattccaacgattctgggttatctaggcattggttttgcaatgggcgtcgtggggaaaggaatcggcttgacggtcattgaagtcctcttgatgtcgatcattgtctatgctggaagtgcccagtttatcatctgtgcccttttggctattcaagcaccgtttacttcgatcgttgcgacagttttcttagtaaacttacgccactttttgatgagtttatcggtagcaccttatttccgttctgcttcattagtgtcaggaattggcatcggcacattgctgacagacgaatcctatggagttttaacgacagctttgcaacaaaacaaaccaatcactacccgatggactcacggattgaatgtcatggcctatttaagttggatctttgccactttcttaggagcgttgttagggtcatatattcctgattctgaagcattaggactggactttgcactagtggctatgtttgttggcttattcctttttcaagtagaggtgcctttaaaaaagaagaccaagcagacggtgctggtgctagccgctgtggtaatttcattggtcctttttatgcgaatttcaacagctgaagtagccgtgattgctgccactttgattggatgtttgatagggacggtgacacatcatgattgattttgttatactgatgatagcttgtggtgtcgttacttggatacctcgggtgctgccctttttattttcgaagaaattagtttttcctgaaagattcacgatctttctaagctacttgcccctttgtattcttggggcgctgcttgttcaaaatctgttggtttttcgtgaaggacaatttccattacttaaagtcaaagaaaccgttgcttgtttaccagcgctagtggtcggttattatacaaaagatttgatgaagatcgttgttacaggcgtcatcacgatggcggcgattcgattctttttctagtaaatcatttctaaggagagaaaaaatgaaagacttattggcatccgtttttagcggattgatcattgatgagaatgatcaaaattactttgtacaaaaaaatggtctgacttttcgcttatcaaaagcagaaggagagcaccatcttggagaagctgtggagggttttggttatcagaatcaaaaacaagaactcgtaatcactacggagattcctaaaagccgccaaggacattatgctttcggaactgtcacggacagtcgtcgagatctaggcgtctttgtcgatattggtctcaaagataaagatatggtggtatcattagatgaattaccaacaatgcgggaactttggccaaagaaaggcgatcgcttgatggtcagcttgacagtggatgaaaaggatcgaatctgggcttctttagcggatgaaaagatttttaaagcattgagtaaacgtggttcagagacgttgaagaatgctgacattacagggacagtctatcgcttgaaacttgcgggaacttacttactcacagatgatttctacattggctttatccatccttccgaaagataccaagaaccacgtttaggagaagttgtctcaggacgagtaattggtgttcgcccggatggtgttctgaatttatcattgaagcctcgtgcttatgaagcaatttcaaatgatgccgctatgatcatgacattcttggatcgagctgcagatcatcgtattccttttactgataaatcgacaccagaagagattctgcagacattcggtatcagtaaaggccaattcaagcgggcgatcggtaccttgatgaaacagcgtttagtggaacaaaaagacggcttcaccatcaaagtcaaaaaatccaattgagaatgcttgtatcttttctcattctaatttataatgattacaatattatctaagagttgacgtctcttagattagaatcgttataaattagcgatgtatggaggcctgtatgaatacaactgctgctttaaagaagacaaaaaaacaacttcatgaatcaggatttaaattgactccacaacgagaagctaccttgttggttcttttggagaatgagaaagatcatttatctgcagaagaaattttcttttttgtgcgcaaaaaaagtccagaaattggactagccacagtgtatcgtacattagaaatcttaactgatctaaaaatcgtggacaaggtgagtttcaatgacggcgtttctcgttacgatctgcgcaaagaaggagcaaagcatttccatcaccatttgctttgtttagagtgtggcagtatcgaagaagtagaagaagatctgctgacaggtgtcgaagacatcgtagagaaaaaataccattttctagtaaaagaccaccgattgacttttcatggagtgtgtcagaagtgtcagacaaaaaatgcagcgaagttgagtgaagcgtaattgctcctcagctttttttgtggttgaactactatcatatcaagctttaatttgttatgataaagaggttgaaagtaggggggacgtgtatgaaagaacagatcatcgattatttgcattatctgacgattgagcgggggctatcccaaaatacccgtaaaagttatgagcgcgacctagagcagtaccttacatttttgacggaacagcacatcaaagattggcaggcggtggatcgtgtcttgatcctctcttttttgcagcaattgcagcaatcagggaaatcctcggcgaccattattcgaatggtatcaagcttgagaaggtttcatcaatttctccgtcaagaacgctttacggatcatgatcctatgcaacacatcgattccccaaaaaaacaacagaaactgcctgatacattgagcctttctgaggttgagcgcttgatcgagacaccggataccaaagaagtgttgggaatccgcgatcgtgcgattttagaagtgatgtatgctaccggccttcgggtcagtgaactgatcgggttgcaactgaaagaccttcatttaagcatgggtctgttgcagacgacagggaaaggtgacaaggaacgaatcgttcctttaggagatctggcgattcagtggatcgaaacttacttggaagaagcacgcccttttttgactcggaaacatccagaagagagtcatctttttgtcaataatcatggaaaacaactttctcgtcaaggaatctggaaaaacttaaaggccctcgtgcgcaaggcaggcattacaaaaaatgtgacgccacatacgctaaggcatagttttgccacccatttattggaaaatggtgccgatttgcgtaccgttcaagaattattagggcatgcagatatatccacgacacagatctatactcatattacgaaaaaaaggatgacggaagtgtataagcagcactttcctcgtgcctagaaatagaggaagacatggaagaaatcaatatcaaactagatgtctttgagggaccgttggatctgttgctgcatctgatccaaaaattggagatcgatgtctatgatattccaattgcagcgatcaccgaacaatatatgcaatatattcatgcaatgaaaagtttagagttagaggttgccggagaatacttggtgatggctgctacactgatggcaatcaaaagccagatgctgctgccaaaacaagagatcttgattgaagaaaacgatccttatgaagaagatccaagggatatgctggttgctcagctattggaataccgtaaatacaaatacgcagccgaacaattatccgaaaaagcggaagaacgaagtttatactttacgaaagatccgatggatgtcgatgcctataaagaaaaaagtgatgaattggcagccaaccggttcaacacgatcgatttattcttggcttttcataaaatgcttgaaaagaaaaagagtcggaaagtactggagacaaagatcacaccagatgaaagtaccattgatgaaaaaatggcgacgatccaattggaaatgcagcaacgaaatgccaaaaagggacgacgttttgattcttttttcaccaattacagcaaaacagaagtcgttaccactttcatggcattattagaattaatgaaaaaaggatatattcgagtagagcaagaaggaaactatgaatcgatcttgctttacccagcaggtaaaacagatgagtaaatatagtgaaatagaagcgattctctttgtcgtaggagatgaagggatcggattagaagaattaagctacttagtcaatagcaaaactgcggctgtctatcagtacttgcaagaattgaatcagcgttatgaagaaaatgaagattcagccttgcatattttagaagttgggaatcattttgttttgtccacaaagaaagaagtcgcaccgttattaaagaaatacgcagaatcgccaatgggcaactctctttcgcaagctgcgttagagacattgtcgatcattgcctacaagcaaccgatcacacgaatcgaagtagaagagattcgtggggtccagtccagcggctccgtacagaaattagtcgcaaaacgattgatcgaggaaaaaggccgtgttgatggaccaggtcgagcaattttatatggaaccactgaatacttcatggattactttggcctaaaatcattagccgaattacctgatattcaagcaatggaagacgaactcgaagaagatggaccagtggatcttttttatgatcgttacaaacaagaaggagactcataatggaacgtttgcaaaaagtaatcgcacatgctggaatcacttctcgcagaaaagcagaagagttgattgtggcaggtcgtgtcagtgtcaatggtcaaattgttaaggaactaggagtacaggtgagtgccaaagatcgcgtggaagttgacggtgtcccaattgaacaagaatcgcccgtctactatatgctctataaaccacgtggcgtaatctcagcagtaactgacgataaaaaaaggaaagttgttttagacttttttactgaagttccagaacgtctctacccaatcggacgattggattatgatacttcaggtttattattgctgaccaatgacggcgatctttcacaaaaactgatgcatccaaaacatgaagtggataaagtctatgtggcaaaagtgaaaggaatcgctgataaaaaacaactattgcccttgtctagaggaattcggatcgaaggcaagaaaaccgcacctgctcgctttgagattttgtcgacagacgctgctactcaaacaagtatcgtccaattgacgattcatgaaggccgtaatcatcaagtgaaaaatatgcttaaagcagttggtttaccggtccaaaaattgaaacgggaaatgtatggttcgttgacattagctgggttgcgccctggagagtatcgggagttgacgaaaaaagaagtcaatgaattaaaaaaacaagtgaaataaccagcacacagcaaaagatgcttaaaaaatttgtcaatcgagaatttttgtgtataatgaaacatgtattataaataaaaggttcgtcttcaggggcagggtgcaattcccgaccggtggtgatagtccacgacctacttcttttgaagtagctgaatcggtgaaattccgataccgacagtaaagtctggataaagaagatagagcgtatttgatttgcctatggtttttcaaatgccctctttttccctgtggaaaagagggcattttttactttgtctggcgccgacaagtaaggaatcaaggaaatttaataggttcgtttgaagaggaatcctgaacttaggaggatttgtattaatgaacaacaaaacaagaaaaatggtaacaatagcaatgtgtgcagcaatgggaacagtcttacagtttattgcgtttcccatcatcccggcgtttagctttttgaaaatcgattttagcgatattccagtaatgatcgtcatgtttttattcggtccttttgctggcgtggcaaccgcgtttctacgttctctcttacacttgtttctatctggtttttcaccagcagatctcgtgggagacacggcaagtttcttggcatcctgtgtcttcactttgccaatgtactactttttccgtaaagggatccatgcgaaaaataaattcgtgggagtggtcacaggaatcctcgcattaactgcttttatgagtattgccaatctatatgtcatcacaccattgtacctgcgcttctttggtgttacagcagatcaattccttggcatgtcattagcgcgttatgtcagcatcggtattattccttttaacttgatcaaaggagttatcgtcagtggggtcttcttgatccttcatgcgaagttgttgccttggttggctcgtaaacaaccgcaacattcaccagttggaaaataataaaaaagatcgtatgttgcttttgagcaaacgcgatctttttatttttctaacagtatcgcccgagtaggacactttttatatgcagctaagactttttcttgctgatcttctatgataaactgttgccgagcggctggttcttgagcaaataagacgataccatcttcatcataatcaaaaatatcaggggcacagaccgcacataatccacaagcgatacagcgctcaggaatgattttgcagcgttgagacatggaattgtttcctttctggaggtaagtatagacatatggatgcttttattttagcgttgtttcatcattctgacaagttgcgtccgtcaaccatttatcaaatactttacggcaaacgaacgagttcagtattgagttatgcttttttttatgatcgcttaggttactttcaagcaatgccgaatcttgaagaggatgaatttaataaaagaatcacggcgctgattgctgccaaacaacttgtagcagatgaaaaagggtttctccagacagttgcacctgcaacgcttactgaagtagagacactctgccgtcatttaaattattttcaattcggtcgccggggggaacagatgtggcgcttggtacagctgcttgttcaagcggctgcttttcaagaaatcagtaatcgatatattcctgtggagaacactcctatgttcacagaaccggttcggcagctgattcggcagcacccaaaattgaagcaggcgttgtttactgagctttggacagtcttcgagcagattccgggagaatttgccgactttttggcagggacgttgacaggacctgagcaaattggtcagactttttttcagctgttaccagataactaccaaaaaatgccttggaatcagttttttccagcggcagcgatccactgctttttatcagtggcaaagaagcaatctcctcttttagcagcagggttaaacccgttttatcaagaaaacctcaaccaaagcatgctgaagacccgtcgcttatttctcagcgggaagtcgattgaggaaatcatggcacttagacagatcaagcgaggaacagtcaacgatcacttgattgaatgggcgatcatcgatgatcagtttccttatcactattttgccacaaagcagcagttccctccattgtcatggaaattaccttatcacattcttcaaaaagaagtgccgctggattttttaagtatccgaatcaatcaaattgcacaaaagcgagggatcctatgttagaacaggcgctcaaacactattttggtcattcccattttcggacaggtcaaaaagaagtgatccaatcggttctgaatcatcaggatacattagcaatcatgcccactggtaacggcaaaagcttatgctatcaactgccgggttatttgctggaagggttggtagtaatcgtatcaccattgctttctttgatggaagatcaagtgtatagtttgcaaaaaaatggtgagagacgagcgatcgcttttaacagtctcttatcattcgctgaacgaaaatttgttcttagccatctacagcagtataaatttttatttattagtcccgagatgcttgttcaaaagacgattctccaagcattggcaaatagtagaatcgcattgctggtcgtagatgaggcacactgtgtttctcagtgggggatcgattttcgaccagaataccttcagctagctgcggtcaaacaacaattaaaagcaccaacgactctggctttgactgccacggcaaccgaacaggtggcacgagatattcaacaaaaccttttaggaaaaacgcatcaagtttttcgctatggaatggatcgcaaaaatattggactgatcgttgataaaagcggcgaagaaaaagacacgcttttaatgcattacttgcagcaattgtcaggtgcgggaattatttattgtgccactagaaacaaggtggaagaactttatcaaaaattacgcggcaagtattctgtggggtattatcacggtggattagccggtgatcagcgtaaagtccttcagcagcagtttagtcggaacgagctgcagttattgatcgccacaaatgcttttggaatggggatcaataaacaagatattcgctttgtgatccattatgatctgccggattcgttagaaaactatagtcaagaaattggccgagcaggtcgagatggcaagcaaagctatgcgatcttactctatcgtcctggagacgaaaccatccattatttctttcaaaaggaactaagtgcagaaagagaacagctggaaatgacgccgcaatctttgatgctttccccattgcaggaaaaatggcaagcaaaaatcaatgagcatggtgccaacaaatggtttgctattttaaagcaaaatgagtgggaaaaaaagcagcagctaaaaacgatgctcgaatacattcactgtactagttgtcgacggtgttttttattggctcattttgacgaagaaaaacaaccgcttgaccagtgttgtgatatcgatggtattgaaattcggcttgaccaaaaggaattcaagccgcaaagaaagaactcgtggcaggaacgtttactaaaaatttttaaagaaacaaattgaatcgttttttaaaagacagttcgattcaagctatgttataatacatcggaaggatattaggaggtaatacgagtgagcaagaaagacaaaaactataattcagaaaatcaagagccgtgggaacaaccaatttatgatacagaatatgaagattctgcctcacgatcacaacagcggaaacaaaaacgcgggaattcactctttttgacgatcgtcttagttttacttttcttgatcgttgcaattcctgttggcgcggggatttgggtcttaaaccgctcaaatgatacagcaactgttgcctcatcaacaagtagcagtacagttgccagcacagaatcatcgactgttgagtcatcgacaaaagtcagtgaatcatctacttccagcagtagttcgtcatcgtcatcatcatcttcttcctcatctgaaagcagtgagtctgaagagccagcgaacagtgaagcagaaggaaacaacacccagaacaatcagggaaatgcagaccaaggaacgacgaatcaaggtgcagcgaatcagggagaaaccaaccaaggaacagagcaatatacgactgttcaagctggtgaaggtccagaacaagtagcagcacgtacaggtatttctgtcgagactttgtatcaattaaacgggatcgatccaagtaatttcatgctttacccaggcgatacattacgaattaaataaaaaaccgctttggcggttttttttcttgaaagttaaaaggccgttgatcggtagttgttgagaaggagtaacaaatgaaaaaaatcaatattgccatcgatggtccagcttcatcgggcaaaagtacagtggcaaaaattttagctcagcattatggatatgtttatacggatacaggggcaatgtaccgtagtatcacttatttagctcttaaaacagggtgctcattagaagatgaaagcgggcttgtggcattaatcgatacttatccaatcacttttgcgccaactgagacaggacaagatgtttttgtagatggaacaaaagtgacagaagagattcgccagcccgaggtaaccaacgctgtttccaaagtttctgcttatcaaaaagtccgggaaaaactggtccaacagcaacaaaaaattgctgaaaatggcggtgttgtaatggacggccgcgacattggcaccgcagtcttacctcaagcggaagtaaaggtttttctcgtggcgagtgtagaagaacgagcagaaagaagatacaaagagaaccagcaaaaaggaatcaccacctcctttgacacattaaaaaaagaaatcgagcaaagggattatttagattctcatcgagaaatctctcccttgaaacaagccgatgatgcagttcgcattgatacaacaggaatgtccattacagaagtcgttgcagcgattcagcaaatcgttgatcaaaaaatggaataatcaaccactggcgctagtcgacctaaaaaaacagaaccgaacgattctcatgagaaatttcattaaatatcggaattttcgcgtagaaatattgttcgaactctggggttttttaggtcggaggggctatttttttttgtatgaaacagtgattttgaagcaaaatagtgaaggaaacgttttttgagaacaattattgacagttttttgtgaaaataagcgaaatcgctttatttttttggcattctaatttaaactaagggatgtagtgcatttacgtacaattgttggttaggaggacacaagacatgacagaatttgaaaataatcaagtggagaatgggaatgaatcaatggaagctgctttggataacttccaagaagtgaacgttggcgatattgtcaaaggtgaagttttagccatcgaagacaaacaagcgatcgttggcatcgaaggagcaggtgtagaaggagtcgttccagcaaaagaattgtctacattgcctgttgaggatatcaatgaagtagtcaaagtgggcgatgttttagagttagttgttatttctgcaatcggtaaagataaagaaaacggcagctatctactttcaaaacgtcgtttagacgcgaagaaagtttgggaagatatcgaaaaagatttccaagcaggtaagatcattgaagcgcctgtaacaaatgtagtcaaaggtggcttagttgttgatgttggcgtacgcggatttgtgccagcttcgatggttgaggaccactttgtagctgattttgaagattataaaggcaagacactcacctttaagattgttgagatcgaaccttctgagaaccgcttgattttatcccataaagcagtggttgaggctgaaaaagagaaacaaaaagaagccttgctagctgatctttatgaaggtcaagaaatcgaagggaaagttgcacgattgaccgattttggggctttcgttgacttgggtggaattgatggtttagtacacgtttcagaaatttctcatgcccatgtaggcaaaccgagtgatgttttatctgttggtgatactgtcaatgtccgtgtcttatccgttgatccaaataaagaacgcgtatcgttatcgatcaaagatacattgcctggaccttggagcaatatcgaagaacaagcacccgttggtagtgttttagatggtgtagtaaaacgactaactagttttggtgcttttgtggaagtcttccctggtgtagaaggattgatccacatttcgcaaatctcacataaacatattgcaacgcctcatgaagtgttgcatgaaggtgatcaagtgcaagtgaaagttcttgaagtgaatccaaccgatcatcggattgctttgagcatcaaagcactagaaaaagccgaggaagcggaagaagcgcctgcagaagatgactatgaattaccagaagaatccactggttttaccatgggtgatatcttgggcgatgcgttgaaagataacgacgaagaataatctagtctagcagcttataacgattcgttttttgaatttgttataagctgcttttttgtttgtcatcaacacttgcaagttagtgatgcattaggtaaactaagaaagattgaaaagcagaagcagctgtattcagcagtttgcttcttataaatggagggtaaaaaatgtcaaatccaacaattgcgatcgtcggacgtccgaatgtcgggaaatcgactattttcaaccggattgccggagaacgaatctcgatcgttgaggatactccgggtgtgacgagagaccgaatttatgcaacaggtgaatggttaggtcgagagttcagtattatcgatacaggtggaatcgacttaggcgatgagccgtttatggatcaaatcaaacatcaagcagaaattgcgatcgatgaagcagatgtgatcgtcttcattacgagtgccagagaaggtgtgacggatgcagatgaacttgttgctcgccttttgtataagagcaataagcctgtgattctagcggtcaataaagtcgacaatccagaaatgcgtgcagatatttatgaattctatacattaggattaggtgatccgtatccaatatccggcagtcatggattagggatcggagatgtgcttgatgaagccgttaagcattttacagaagaagcagaggaagaggatgaatcgatcatcaaatttagtttgattgggcgaccaaatgttgggaaatcttcgttaatcaatgcgattttaggtgaagaacgtgtcatcgtttcggatatcgaaggaacgacccgggatgcgatcgatactcattttacaagtgaaaatgggcaagagttcactatgattgatactgcaggaatgcgtaaaaaaggaaaagtttacgaatcaacagagaaatacagtgtcatgcgagcgatgcgtgccatcgaacgttccgatgtggttctaatggtcttgaatgcggaagaaggaatacgtgaacaggacaaacgaatcgctggctatgctcatgaagctggccgtgggatcatcctagttgtcaataaatgggatctgctaaaaaaagaaaccaataccatgcgagactttgaagcggagattcgtgatgagtttcaatacttagattatgccccaatcatctttgtatcagcggcaacgaaacagcggttgaatcagttgccagctttgatcgaagaagtcagcatgaatcaaaacatgcgtatcccttctgcattattgaatgatgtgatcatggatgcagtagccatcaatccaacgccaacggataaaggaaaacgattgaagattttttatgcgacacaagttgcggtcaagccaccaacatttgttatttttgttaatgaagaagagttgatgcatttttcttatgcgcgctttttagagaatcagatccggaaagcatttacttttgaaggaactccgattcgaatcattccaagaagacgaaagtagcgattttatcatactttgctgcttttgacaaagaattctattcttttgacagaaaaacgataaatcctaaaaaaaacagtagtaaaaacgttaaaatccttgatattacaacgttcttatgataacgttatatcagaatattgatggatatcaatatttgacaaaaaacttggaccactcaagatttttgttgatgtatgacatcaaaaaaataatcaggaggtgaaaccatccatggcaaataaagcagaattaatcgaaaaagttgcagcagctactgacttgacaaagaaagacgctacagcagcagtagacgctgtcttctcaacaattcaagacgctttagctaacggtgaaaaagttcaattgatcggctttggtaactttgaagttcgttctcgtgcagaacgcaaaggacgcaacccacaaactggtgaagaaatcaagatccctgctagcaaagtacctgcattcaaaccaggtaaagctcttaaagacgcagtgaaataattgagtcttccaaacccttgagtaatcaagggtttttttgtacataaatttacttatccctattttcatcaaaaatccaatgtagatccgtctactaaaagtacatttatcggagcaattgcaaaaaaattcagaaaatttattgacaagaattttttttcgcgctatattattaaacaattacaagaaaacagcaaatattttaatgaaggagccattttttatgcgcaattttaatcaatatttattagtcattattattgagaccaggacttagaacacggaagcaaaatttatccgtttgtttgagtcctatttgcgtaagtaaaatgggattctggcaaagcatcccagtttattataaaccggggtgcttttttttatgaaataggcgggagatgatggaattgagaagtgatcagataaaaaaaggcattgaagcagctccagcaaggagtttgctttatgcaacaggacaagtaaaaaatatccaagatatgaataagccttttattgccatttgcaactcgtatatcgatatcgtacctggtcacgtccatctgcgagaactggcagatattgccaaagaagccattcgagaagccggggggatcccttttgaattcaatacaattggggtagatgatggaatcgccatgggacatatcgggatgcgttactcattgccaagtcgtgaactgattgctgactcagctgaaacagtcatcaatgcccattggttcgatggtgttttttacatccccaactgcgataaaattacgcctgggatgatcttggcagctatgcgtaccaatgtgccagcaattttctgctctgggggacctatgaaagccgggattgatcctaggggccatcagacgacattatcttccatgttcgaagcagtcggcgcctttaaagagggcaaaatgtcacaggcagattttgaattcatggaaaaaaatgcctgtcccacctgtggttcctgtgccggcatgttcacagccaattctatgaactgtcttttggagattttagggttggcattaccaggaaatgggacgattctggcagtttcgcaagaacggcgggaacttgttcgcaaagcggcattccatctgatggatctagtgaagaatcaagtcaagcctcgggatatcgtaacagaagaagccatcgatgatgcgtttgctcttgatatggctatggggggctctaccaataccgtcttgcatacattagctattgcgaacgaaggggagatcgattacgacttgaggcgggtcaatgagattgccgaacgagttccttatctctcaaaaattgcgccatcttccgcttattccatgcacgatgtccatacggctggcggcgtctctgccattatacggcaattggtcgatatcaagggggcgatccatccagatcggctgacagtcacaggcagaaccttgcgggaaaatgtcgctcaggcgacaatcaaaaatgaagaagtgattcatccaaaggagaatccgtacagccctgtcggcggcttatcgatcctttacggcaatcttgcgcctcagggaagtgtcatcaaagtggggggtgttgacccaagcattcagctttttaaaggaaaagcaatttgtttcgattctcatgatgaggcagtagccgcgatcgacaatcatacggtccaaaaagggcatgtcgtggtgatccgctatgaagggcctaaaggaggtcccgggatgccggaaatgttggcgccgacttcgagtattgttggacgagggttaggcaaagaggttgcactgatcacagatggacgcttttcaggagccacgagagggatcgcagttgggcatatctctcctgaggcggcagccggtggtccgatctctttgatccgtgatggagatgacatcgtgattgatctgcgaaatcgctcattggaagtattagtctcagaggaagaattaatgctgcgtgcacaaacacgtccgaagtttcgggctaaagtgaagaaaggctggctggcacgttatacggcattagtcacatcagcaaataccggggcgatcatgaaaatcagcgaggaggaagtttaatggagaatatccagttgaatgaagtaactaggaccggtgcagaagtgttagtcgatagtttgcagaaacaagcagtagaactgattttcggataccctggcggtgctgtcttgcctttatatgaccaactctacgatgctgcgattccgaatattttagcgcgtcacgaacaaggtgctgtccacgcagcagaagggtatgccaaagccaccgggaaagccggcgttgtcctagtgactagtggaccaggagcaaccaatgtggtaacaggtatcgctgatgccatgagtgattccgttccattagtggtgatcaccggtcaagtagcaacagccggtattggcaaaaatgcttttcaagaggcggatattctagggatcacattaccgatcactaaacataattaccaagttagacatgtcgatgatttgccgcgagtgatcgcagaagcttttcatatcgctaccacgggtagaaaaggtccagtggtgatcgacttgccaaaagatgtcacgcttcagcggacagccgcagtcattgaactgccgattgagcgaaaaagctatcaacccaccgtctttccatctattttgcaaatcgagaaattgatgaattgtttaaaacaagcaaaacgtccagttgtcttggcgggagcaggggtatgtgccgccaatgcagccgaagaattgcgtctgtttgtcgaaacccatcatttgccgattgtaaccacgctcttaggtcttggattggtgccagcagatcatcccttattcttaggaatggggggcatgcatggcacgtatgctgcgaatatggcattatctgaagcggatttgatcatcaatattggctcacgttttgatgaccgattagcaacagccggcagtcaatttggacaacaggcaatcattgctcatatcgatattgatcctgcagaaatcggaaaagtcgttcaaacaactattccgatcgtggcggatgcgaaagcagctttgacccagttgctgcgctatcctgcggaggaattagattgcaaggaatggctcaatcgttgtcaaaaacggaaaaaagaacatccttatcggtatgaccgcgaggaaacaaaggaaatcaagccgcaaaaattgattgaagaagtgggacgcttgacgaaagaggaagccgttattgttaccgatgttggtcaacaccaaatgtgggtcgctcaatactatccttttcgatttcccaaacagctgatcactagcggaggtttaggaacaatggggtatggcatccccgcaggcataggggcaaaatttgcttgtcctgaaaaaacgatagtcgtttttgtaggcgatggcggtttccaaatgaccaaccaagagtttgctctgctaaatgattatggtctggatgtcaaattcattttgatgaataaccgctctctcgggatggtacggcaatggcaagaaacgtttcataatgaacgccgttctgcttctgtatttgctaaacagccaaattttggccaattagcagaagcgtatggcatcaatagtgtgcggatcgaaaccccagatcaattgaccaacgatttggccaatgcattgctagaacctggtgcacgactaattgaggtactgatctcgccaacggaacatgtgctgccaatgattccaccaggaaaagccaatcatgagatgataggagtttaaaagactatgaaacgtatccttgctgccatcgtgcataacgaagctggtgttttaagccgcgtcaccagtgtgttgaatcgtcgtcaggtgaatatcgaaagtatttcagttgggaccaccgaacagccggaattttcgcgaatgacgatcattatcaacgcagaaaacccactggagacagaacaagtgacaaagcaattgaataagcaaatcgatgtcttaaaagtttcagatattacagaagacccccatattgaacgggaattagtgctgatcaaagtgaacgcgccaacgactacacgttcggagatccaagctgtgatcgaaccatttcgagcccacatcgttgatgttgcattgaagactatcgtggttcaagtagcgggagactcagagaaagtagcagcctgtatcgacgtgttgcggccttatggaatcaagcaaatggctcgtaccggtgtgacaggtttcactagaggttaaatgcaagaacagttgcttttaataaaaaaagatttcggagggaagcatacatggtaaaagtatattataacgaagtgacagacaatttaggagataagactattgcaatcattggttacggttctcaaggacatgcccatgcacagaatttacgggatacaggacacaacgtcgtgatcgggattcgtgcaggaaaatcagctgagaacgcaaagaatgatggatttaccgtgcttccagtttctgaagctgtacaacaagcaaatgttgtgatgatcttagctcctgatgagatccaaggagaactttacgagaaggaaattgcgcctaatctttctgcaggggatgcattagcctttgctcatggctttaatattcattttgaggtcatcacgcctccaaaagaggtggatgtcttcctggtggcacctaaaggaccaggccatttggtgcgccggacctttagcgaaggatttgctgtccctgcgttgtttgctgtttatcaagatgctactggcaatgcacaagagacagccttgtcctatgccaaaggaatcggggctacaagagtcggtgtactagaaacaacgttcaaggaagagacggaaacagacttgtttggggaacaagccgtattatgtggcggactgacaagtatgatcgagactgggtttgaaacgctggtagaagccggctatcagccagaactagcctattttgaagtttgtcacgaaatgaaactgattgttgacttgatttatgaaggaggattcgccaagatgcgtgattcaatctccaatacagcagaatatggggattatgtctctggttcacgaatcattaccgaacaaacaaaagccaatatgaagaatgtcttgaaagatattcaaaacggcacgtttgccaaaggttttattgcggataatcaagctggttttccggaattcaaaaaaatgcgggaacaaaacgggaatcatccaatcgaaaaagttgggtcagaattaagaaaaatgatgccttttgttacgaaagattaaggaggaacagtgattgctggtatctgtcgatcaaatagaacaagcacatgaaagcttgcaatcagtcgtttcaaagactcctttacagcatgatcggtttttatccgagaagtatcaagcgactgtcttactgaaacgagaggatcttcagaaggtccgatcgtttaaattgcggggggcatattatgcaatcgcacagcaagatccggctatactgaagcggggggttgtctgtgcaagtgccggcaatcatgcccaaggggtcgcctatacctgtcatgaattgaaagtgtcggcggttatctttatgccgacgacgacaccgcaacaaaaagtagcgcaagttttgttttttggcggtgattttgtccgtatcgaacttgtcggtgataccttcgatgcttccgccgaggcagcccaacactatgccgaagaccatcaaatggcgtttattgatccctttgatgatcccgccattattgcaggccaaggaacattggcagttgaactgctggcagaagcaaaacagcgcaattattctatcgattatgttgtggcagcaattggcggtggcgggttgatcagtggtgttgcaacttatttgaaagcaaaacagcctacaatctcaatggttggtgctgaacctctaggcgccgcttcgatgcaggcggcttttgataatcatggtccgaccacattagagcagatcgataaatttgtagatggagcagctgtcaaaaaagtcggtcaattgacctaccagcatgcagctcagtacgtcgatcgaatagtagcggtagatgagggtttaatttgccaaactatcttggacttatacagtaaacaagcagttgtggcagaaccagcgggagcactgagtgtcgccgctctggaattgatcaaagaagagattaaagggaaaaccgttgtttgtattatcagcggcggcaataacgatagtactcgaatggcagagattgaggaaaagtccttgatttatcaaggcttaaaacattattttgtggtcaattttcctcaaagacctggggcgttgaaagaatttgttagcaatattttgggtcctacggatgatatcactcgatttgaatataccaaaaaaatcaatcgcggaacaggaccagtactgttagggattctgctaaaaaggcaggaagatctgcccccactactggcgcgaatgtcaagatttgatccacaatatattgatttgcgggacaatcaatctctctatactcttcttgtttgattttatgaaccaagcgttacgaaacaaacgacctttttaaaaaaaagaggtcgtttgttttttgatttcaaatccatggctttccctcatcctttcgctagttagtaggtgaaatggttgattcttgttataatagaagtaacaaatcgtagatggggggcggatgtatggaatttgtcttttctagaaaagaacagcagacgcaaatcttgtatggagaaacattgaatgctgttttacggacgcaggaaatttccaatgatcaagtcatcattctcacaaaccagcggtattatgatcgtttctctgaaaaactgacccgtttgtttttacccaaagaagtcagctggtatatttgtaccaatcaaatgtattgcaataattttacggaatttcaggcctttatgtccttcctaagccgcttttcgaaacaggagaactatttgatcgtgggtttcggcaatgaaggtgtgctggcgttaagtagttttattcactacacgtcgattctgactagcgatctttggttgatcccggtgtctttacgggcgttagctaaaagtgtcaaagaatctgcgatcattgttaagaaaccagatattcctgttttgcaaagtcccaatgtaccgcaagtggtcgtatacgatcaaacgattgctgaaaaacaaaaagatgggaagttggtggacttacttgtattgattcgttgcggactgctcacggatcaagcttttctgcgggaactctttcgcacgtttctgacagaaaaacaagtaaacaatcgttcgtttgcagcatatacagatcgggtgatccaagcctatcaagcaaacggtgcagcacttgaagaatatggacaagtctttacagatgctttttataagactgaaaatggacatttgctgtctgatgcaatgaaacttttttatggcctactctttcacttaatctggaatgttcaacaacagcagttagcagtcaaattagataagctttgcttgtggcttgaccaactagggtttcctttagtattgcctgaccaactatctttaagcgactattttcagcaagttctgctgttacagaaaaaagagaaaaaactgctttttttatcagaaattggtacaatagggggcagaaccagcgcattagaagaggatctcgtccagacaatgagcgcttaccaaacaataatcaatcagataagaggaacttagatggaaacatacagtgaaaaaatgttacaggcattagcagccgagaatttagctgatgcgcaattgaattttgcaaaagccctgcaatcagatcaaaatgaagtcttagccgaattaggagaagaattgatccaaatcggctttttagaagaagcaagagaagtatttgatacactgcaagaacgtgaccccgaaaatgaagaatggttgctatcgttagcagaaattgctatggaaaatgatcaaatcgacgaagcttttgattatctagatcgaatcacaccgcaaagctctttttatccacgagcgttattgatcagtgctgatctctatcaattgattgggatccccgaagtcagtgaagcaaaattattggaagctcaaaagctgctgcccaaagaatcgctgattcgttttgcactagcggaattgtatttttcaaccgaccgttatcaagaagcggcagagttttatcaaggattactaaaggaaaatatccaggaaatcacaggtatttccttattggaacggaccggagccgcattgagtatggctgggaaatttgaagaagccatcgaatatctggaagcaagtctagctgaggatcaaacagatgaccgtctattccaaaccgctttagtttacttacaattaaaagaaaatgagcatgcgattcgatatttgcagcagttgcgggcactgaatccgcaataccgttccttgtatctctatttagcagaggcattacaagaagaagagcaactggaagaggcacaaactgtcattgaagaaggaatccatgaagatccatttcaagtggatttttatcattttgcatcagaaaatgcgtatcggttgcatgacagcgaagcagccgaatccttcttattaaaagcccttgagacgggggaaaaagaagatgaaaccctgcttacactgagtaatctttatttgaatgaagagcgttggcaagaagctgtgttggctatcgagaagatggaagacaatgaacaaccccatgctctatggaatttagcacaggcttataacgcgttagaagagtttgaccaagcagcgaagttctatgaacaagcgaatgaaggattgcagcatgaaccagcttttatgaaagaatatggattgttcttaagagaagaaggacgattatcagaagctctacctttactgagacattatctggctcacgaacctggtgatctggaagtgcaatcgatcgtggaggatctattagaaagataggtgagggaaatgaacatcaatgtacaagaaaagaaaaaatttctcaattggttagtttctactgtatcattcagccgacgagaagtttcttgggttctgaactacctagcaaatcatgaagccattttgacaaatgttcatattgttgaaggggcgatgcagacagatcgggggttgagtgttcgcagtacagagattggcggcgagccatttgtgttgacgatccagaatcaaaccttttatgatatcgatcaaatttttcacgaaatcaggatgaattggaaacagccgctttatttagaatgtatctttccaaatccttgggaaaaaccactttatttagctgttctggaggacaatccttttgaacggtggaatgaccatgttgacgaagaagtacaaaaaaatgtgacagaatatcttgacaaagaagctatgcagctaaaaattgagaaattataccgccaaatcgatcttgctttggaaaatggggatcgggatgcttttttggaattatcggatgaagtcaaccgcttcaaactcgatcaaaaagaaaaaagtcattaataaagctattaaaaagcgctatgtgaagtaataaaaactagtggaacagaaaagaaccgcaagaaagaagaggactcccagcaccgagcgttcgtcgtttgcaacagtgtgcgggagaaatcaagtttcttgcggttttttctttataattagataggatggaagaatggggttatctttttgattttgctgccttgcgttgcaaaaatcgtgatttaggacgtaaataagtgaagccttccccttcgacttcatggacattgatcaccgacacgaacgcttgttgatcgaagtcggcaacgatccgtttgacctctgaaatttcccggccgcttactaccatataaatgatccgtttgttaccaccggaataggctccttccccatttaaaaaggtgacgcctcgttccaattcattcattaagacaggggcaatttcttcactatgattactgataacaatgatcccttttgctgaatagccgccatctaggatcgaatcaatcacgcgagcgaaaacataggaaaagattagcgtgtacatcatgcgtttcaaatcgatataggttaaggaaagcaatagaacgaaaacatcaaagatcaagagagaacgaccaatcgtgatcccaaagttcttttctaggatccgggctaatacatccacgccacctgttgtcccaccaactttataaacaacaccactgccgatccctgcaattagtcctgcgagtaacgcaacgatcagtaagtcatgctgcagatcgatcaataatggaaccgtctgccagaaacctaaccaaaatgaaagaccaaaggttccaatcactgtatagactagcgaacgtctgccaagaatcttacctcctagcaaaatgattgggatattcaaaatcagtgtactgtaagcgggattgatgtcccacaatgcgcgcatgatcaacgtgatcccagtgacgccgccttcagctaaatcattaggtatatttaaatagacgagaccaaaaccatagacactcgttcctagaacaattaaggcaatatcgcggactgtccgccacgaaaaaaaagatcgcatcctgtttcccccatttctaaatctcacaagtaccaatttagcacgaaatttggcattaaacaatatgagcaagtcgatcctctatctaggcaggtgcgttttcttttgctaaaatgtgaaagaaagggtgaagaggatgacagaaaaacgttcactatatgagatgcaagaagaagtcgatgcctatatccaacaattcaaggcggggtatttcagccctttagcacagatggcccgacttactgaagaagtcggcgagttggcaagggaagtcaatcatcactatggggaaaaggccaagaagaagacggaagtcgagaaaacagttgctgaagaactaggtgatgtcctttttgtcaccatgatcatggcaaattccatgggtatcgatttgacggaagtttttgaatccaatatgaaaaagttcaaccgcagagatgcgtatcgctttgaaagaaaagatgggaaaatgaatgaagctgactaagttaccacaagaatttgaacaagcaatccctgtattgcaaagaatcgaagcagccgggtttgatgcctactttgtgggaggaagtgtcagagatacaatcttaggacagccaatccatgatgtagatattgcaacaagtgcctttccagctgagatcaaagaactttttcctcgtaccatcgatttgggtatcgagcacggaacagtccttgttttatgggaaaatgaacaatatgagatcacgacttttcggacagaagaagcctatcaagatttccgtcggccagacaaagttgcttttgtgcgctctttggctgaagatttgaagcgcagagattttacaatcaacgcttttgctctgaaaaaagatggtgaaatcattgatttgtttgatggactggcagacctgcaactgaaaattctgcgagcagtgggtcagccgcacgaacgatttcatgaagatgcactacgtatgatgcggggcttgcgctttgtcagtcaactgggctttacattggaaccacgaacatttgaggcaatttatgacaatcatcagctattggcaaaaatatccgtggagagaatcaccattgagttcgtcaaattgctgttaggggcacatcgcaattcagctttaaaggcttttgtagcgactgaatgttatctctattgtccaggactgaaacaagccggtgaagctctgttgcgaatggctgatttaccggagagaccattgaacaatgaagcttctgcctggacactattgattgaccagattggactttctacagcagaagttcgtccttttttgaagcaatggaagtgttccaatgaattgattcggatggtccaatcgttattcgagggagtattgttgcggaaagcagggccgtttagtgatgaagcattataccatctgggcagcgaggccgctcgactatcagaagaattgctatactattacggacaagaggtagatccctctgttagtcaagctcgctaccaggcgttgccaatccattcacttaaagacttggccatcaatgggcgcgacttgctgagccactttgaccaatccggcggtccttggatgaaagaagtgctagcagctgccgaaaaagcggtgattgagaaacgagtcgcaaatgaagagaaagcattattggcttttgccaaaacaatcgtattaaataacctataaataagcaggtgagaaaacaatgatcgaaaaagaatttttggttaccgaggaagatacagctcttgcagttggatcgggaggactgcctgtcttagcgacccctcgtttggctgccatggtagaagctgtctgttttgaagcattggaatcgcgtatagcgtctggtaagacaacagtaggaacacaatttacgatcgagcaccgggcggcttcaggaatcggtgcaaccgttcaggtatgctgtgaagagatctcgaatgaaaagacgtatgagtttacttttcgtgtctatgaaaacgatcaactgctagcgacaggtacgcatcatcgagcggcggtcgatatcgaaggttttttaaaaaaagtgagcgagaaagaaagttaatttgtgctccttagcagacaatgtgttaaaattgaaatgtattattaaaaaaaaggagcgttatgtcatggcaagagaaatgaaagcattgaaattttatttccgtaatggagaaacatggacgattgagcgccgttatattggagatttgtggatcaagcaaatcactactagttttggccgcatccacggaagcgaatttgttgagatccatccatgtgcaggattcaaaattgaaatcttccaagaaggggatcatgttgcaacacatgatatcaatttaggtggattggaattaggcatgttcgcccgcgctttgaaatacgaagatattgaacgaatggaaattctttaccgtaatggaacacccgatcttgtgtacttcccatacaaagacaaagatactgaaggattagataacgtttatcaatcaacaaaaatcagtgaaaaaacaaaaagcctttatattgtgattgatccaaaccaaacagtcgaagacgtttaccaagaacattttgaagaataaaaaaaagcagaactgagagcttctctctggttctgctttttcattacaatcactgataagtgcgaaaaaagtcggtatatttttttaataaaagatagtcttgactgacggcatctttaagtatgattttgtctccaagcaagcttttacgagcattttggatgatgcggtgttgaatatcatgatcgatcaagtaatcgatctcagtacgtttgatttccggagaagcactctcgcgatttttttcaagatactgcaaaagatcatattcaagatgtccggcatcattgattactcgtttgtattcgattttgtctaccttcacacgatcacgctcctttatatgataagttaccttatttccggagtaatgtaaaaaaaatctatatgaattagtaaatttttaaacacctgtttggtattgcatcaaaactactttacgcttagaagaaacagctagatgtgtcgcaagacttaaacagaaaatgaaaacaaaggagaaacagatgaaaaaagcaagagttatcgttgttagtggagtgactgcttcagggaaaaccacctttatccaaaaggtcgccaatctatgtcccggtacagcagttttatcttttgatgattatagtatcgatgcattgccttctgcaccatcctctgaggctctgttaaacgaaccctacgaagcaatcaatcaatttgatattcaaccattgataaatgacctaaaacaaatcattcaccactgtgcgctgatcttgatcgattttccgtttgggtatgtccatcagcaactcgcacctgctatcgacaaggccatttatttaagaacacctctggatattgtcttgggtagactaatcattagagactttcaacaacagccagagaaaattattaattgggtcacggggtatctagaggaagcgcgaccgctttttttgatgcacgaagaaattgtttctccacaagcagattatattcgagatgggacgattgattttcaagaccaaatgacttggttcaaagaagaagttctagcggaaaaaacgattttcgcagaatgattgttggaattgggaaaaatacttgtcacgtaaagaataaggtcatcttttgagagataaaaaaaggggatcttaattttccaggtaatcaaagggaaaattggggtaagcaaaactttctttgattctatactttcccttgctgtattattatttatacgcatatttagtctatagttaaaaaatagcattattaacaattaaaaacaagttacgattttgtcatctatctattttaaagtgaacatatgggtatagctcaaaaataaaaagccaactgcaatgcttgtttatcagcaagtgcagtcggcttaaaatgaattattttgtttcacggtgtaaagtaacttttctttcacgtgggcaatattttttcttttccaaacgatcaggattgttacgtttgtttttgtttgttaagtagttgcgttctttacaagaagtgcactctaatgtgatgtttacgcgcatgtttttccctcccatatattcaagaatcctctaagatttctctcagactaaaatataatagcatgtttggcaaaggaatgctagtagtttaatgaaatttgttaagtaattttacttgacgattttttgaatgaaatcaaccattttcatccaatttatttttcacgtcttcgatcatttttgtataagcaatcggtccgttatacagccagctggattcaggtccaaactcccaaagatttccttctttgaccgctttaagattttgccaaacttggtctttaaaaaagtcggctccttgatcgctgtttactagaatcaggtaatcagcatctaattcagctaatttctccaaagaaacggcagaccagtcagctgtcgctgttttgctgatcttagaaacaagtggcggtacagagaatcctagttcatgatagaggagctgaccgctggaacgatcgtcagcaaccataaaagcagaattgttggtgacccagagaacagccaccgacttcccattgattttacctgaaaattcttgcttagttgtttttactaagtcatcatagtctttttctactgtttttgcttgatcttctttatgaagaacttttgcgatatctgtcaaacggtctcgccaagagacattttcaccatttttgactacataagtaggggcaattttgctgtattgtgcatatttatccccttcaaccatcgtattgctgtcgatcagcaacaagtctggttcataacttaagacgtcctcatagggcaagtcgtagctgatccttggtacatcacttagtttctcttgcaaatagccttgatcactgttattaccaacagtccattgtgctactggtgtgacgttcaaggctactaagtaatcttctaaataactgccgatgattcgctttggatcatccgggattgttacttcatgtccagccgcatctttcagcgttgccgtctcagctgaggaagatgacttggtattattggaattagctgaacaagcactcaatgctgttaagctgactagggtacaagacagccaaaaaagtgtttttatggttcgttttttcattaggttcctccttataggataaatgagaatcattctcactttctttttgtcattatcacgaagaaaaagtgatttgtcaatccctggttttttgctttgaagcattgacggatagaaggaaaaccgtcataattgataatcattatcaatagaattttgagggaaagatatggcaaacttacgcacggtcgatttgactgtcggctatcaaaaacaaaaaattgtgcaaaagataacaatcgacatcccagaagggaagatcattggtttgattggacctaatggtagtggcaagtcgacttttctaaaagcattagcccgaatcctgctaccaatggaaggggaagtttatctaaatgaacagaatctacaaacgatcaaaacgaaggaagtcgcaagccagattgctttgttgtcacaagtcagtgattcttccatcggattaaccattcgagagatcgtttcttatggtcgttttccttatcaaaaagggctaggtcggttgaccgcaaaagattatcaagccattgaatgggcattagctgcgacagatttgaccgaactagcggatgctggtatccatacgctttcaggaggtcagaaacagcgggtttggatcgctatggctttggcacaagatacagagattgttatcttagatgaaccgacgacttttttagatccggcacatcaactagaagtgctgttattgttaaagcgaatcaatgaaaaatatgggaaaacgatcattatgtcgattcacgatctgaatcatgcatctcgattttctgattatatttttgccttaaaagaaggtcaattaatgacttgggggacaccagaagaagttttgacccattcatggctccaacaattgttcgctatcgaagctgttttaggtacgtttcccaatagttcgaaaccgttgcttttgacctatgaattaggagccaacacatgaaaaaatttacgattcttttgcttgttctaagcggattattggtcgctgtgttttttctggcattgacgcaaggggcagctgatattcccttaataactattaaagaggccttttacgcatttgatccagaaaatcaaacccatcaagtgcttagaaatatccgtttgccgcggatctgtgcttcgtttattgttggcagcagttttgctgtaactggtgccatcatgcaaggagtcaccaaaaattcgctagcagatagcggtttactaggaatcaatagtggggctgcagtcggattagccgttgcatttatcttgtttccctcactacaaccgaatcaggcagcgttgttttctttcttaggcgcttttctagctacttcttttttatttttgttgacgaagtattcaaggatcggtatgacgccgactggattgattctagcaggtgttgcattgagttcttttttttctgcgattagtcaagtattatctttacaatttgatttgaatcaagacttggccttttggtttattggcggtgcagcaaatgtaacgtggacacaattacaagtgatcacccctatttatctggtggcgctcttcatcatcctaggactcgggaaatctttgaatttgctggctatgggagatgagacggcaatctctttaggcaaacatcctgaacggattcgacttgtttctttagccgtagttgttctattagctgggatggctgtttcactggtgggaccggtcagctttattggattgatggtccctcatgtgattcgcggactgattggcaaaaattatcaaatgatcttacctttgacgatagtggcggggggaatattggtaatcttagcagattgggtaggacgaatcattcagccaccttttgaaacgccttttggaatcatgatggctttgattggggttcctttcttattagtgaagattcggagggaacagctatgaagaaaaaaatcggtttcctttttgttttggttcttctggcgttttgtggcagtatcatggtgggaaagacgttcttttcttttgatctctggctcgctctttggcagcaaactctaacagctagccagtcattgatattcttcgatttccgacttcctcgagcagtactggcactgattgctggaagtgcgtttggcttctcaggttttttgttacagggagtaaccagaaatgagttggcggatgcaagtattttaggaatcaataatggagctggcttatgtgtcatgctctacttaggcttttatgcccagggctcccagctgttaccactaattggtatgattggcggactattagctgcactgctagtctatgctatcgcttataaacagcggcagctgctttcaatggagcgaattttattatctggaattgctgttaatgctggacttgcttctgcgtcgttattattgactgttcaattgtcaaaagaacgatatagttttgttacggcatggctttcggggactatctggggaacttcgtggacgcaagtactaagtttgttgccttggttcttgattctaggattgttggcattcatgattacacctttgatcaatttactgggttttggagaagaacaggcgatcagtttaggtgttcccctaaatcttttgcgcaccggtttgttgttcgtagcgattggcctggccgcaagcagtgttggctatactggaaacttatcttttattggtttattggcgccccatatcgctaaacgattgattggcaaagaatctcgttgggcattgatagcagcgggaatgattggtgctattttggtgctagtcagcgacacagtcggccgtcttttacttcaaagtggcgaaattcctgctggtatcgtgattgcgatcattggtgctccgtactttttgtttttgctgattcgtcaaaaaacgtagtcgtgagaattttttcacgattgcgtttgctatttgagtccggtttttggtactattcggagtaggagttggttaattatggataaaaaaattttgcgtgaacaagggctaacccgactcaagcaactggatccacgaacaaagcaaaccaaagagcagatcattcagtctttgttgtttgcttccgaagagtggctcgaagcagaatccattggcgtgattcggtcattgccgtttgaatttgatacaaagccgatttttgagcgcggatttcactctggcaaacaaattgccgtgccacgttctgtgagaaagaaacttcacttttatcaagtggaaccacagactgaatatcagctttccagttttggggtagaagagcctctttctcaaaaaaaaatcgatgcattggacctggatcttttgatcgttcctggtttgattttttctcatgagggatatcggattgggtttggcggcggttattatgatcggtttctggcagatttccaagggaaaactgtgtcattggtttttgcagaacaatttgatgtccggtggcaacctgattcttttgatattccggtccagaaaataatcactgataaagtttctttcggagaaaaaggagtagacaatgaataaacaaatgaaacgctggcttaatcgtccaatctttacttatacgtttttagccatccagacgttagtctttattatcggctatattagtccgatgactcaagtgatgggggtgatgtttggcccttatgttgcttacatgaacgagtattggcgttttgtaacgccgattttcattcactttggtctcgctcattttgcagtgaattctgttattctttattttatgggtcaacaggtggaagcgatctacggtcatgctcgtttcttcattttgtatttgatgagtggggttatggggaacgcgatgagttttgcctttaatcaggccggtgtccaatctgcaggtgcgagcacgtcattgtttggtctgtttggtgcttttctgattctgggactccactttaagaatgattaccagatccaagcgatggttcgtcaatttgcattgttcgttgtcttgaatttcgtatttggtctatttgatcaatcgattgatatttggggacatgtcggaggaatcttaggaggattcatcttaggcaatgcattggctttaccaaagaacttcgaggaatattcgattcatacccgcattctttccgccattgtttttctttttttactggcagtttttgtgatatatggtttaaaaaagtatcaaatacttgtataataagcaggaagtgtgtttatggaaacgttatatgacgtacaacaactattgaaacaatttggtgtctatatttatgttggcaagcgaatctatgatatcgagttgatccagatggaagtcaaaaatctttatgacagccgtttgatcgatcgagatacctatttgaccgcttggcgcattttaaagcgtgaacatcggattgaagaaagccgggaggaaaataagtgatggacaaaaaaatcatcgggattgatctaggaggaacaacagtcaagtttgctgtgttgacttctgaaggagagattcaacaaaaatggagcatcgataccaatattcttgatgagggttcccacatcgtaccagagatcattgcatcaatcaatcatcgtctggatttgtatggcatgaaagcagaagacttcattgggatcggtatggggactccaggaagtgtcgatcgcaaaaaaggaacagttatcggtgcttacaatttgaattggaaaacgttgcaacctgtcaaagaagcgattgaaaaagggacagggattccttttgctatcgataacgatgccaatgttgctgcgttaggcgaacgctggaaaggcgcaggtgacaacaatcccgatgtgatctttatcaccctcggtacaggtgttggcggtggaatcatcatggaaggacaacttttgcatggtgtagcaggctgtgcaggagaaatcgggcatattactgtagatccagaaggatttgaatgtacttgtgggaagcgtggttgtttagagaccgtgtcaagtgcgacgggtgtcgttcgggtagcaagacatttggcggaagagtatgctggcgattctgaattgaaaaaaaatctggataatggcgaagatatttccagcaaagatatttttgaagcggcccaagcgaaagatccgtttgcattgatggtagtagataaagtctgcttctatttaggccttgcttgtggaaacttgggcaatacactgaatccttcaagtattgtactgggtggcggtgtctcagcagcaggtgaatttttacgtagtcgtgtagcagcttactttgcagaattcacattcccgcaagtaacggaaagcacggaaatcaaattagctgagttagggaatgatgctggtgtgatcggcgctgcgtcattagcattacaatttgcaaagtagagaggaataggtaagatgtctgtttggaactggattaatattattttaggattgattttattggcaatcgcattgaattgggcgtacttccaaattatgggaagacgatcagccaaaatcatttccgaagaagaatttaaaaatggcatgaaaaaagcacaagtgattgatgtgcgggagaaaaacgagttcgatgccggtcatatcttaggtgcacgaaatatcccatttacggtattaaccaattcgtttagcgcatttcggaaagatcagcccatctacttatatgatacccgtaaatctctaagtatccgtgctgcgaataaacttcgcaaagaagggtttaaagaaatttacattctaaaagaaggctatgaaggctggagcggaaaaacgaaaaagaaaactagttaatcaatcaaaagactgagatcaatgatcaaacaagatgttcctaagaggcgcgagaatgaatcgttagaaaccattcagcagctgtaactgagaatcttgtcatcatggactcggtcttttttttttgaaagaatgtgttaaggtagattcaaaggagtggaaggaaatgattaaagtaaaacgtgtatacgaggctgcagcacccacagatggttatcgggtccttgttgatcgaatctggccaagaggcgtcaaaaaagaagtggcggcgattgattcttggttgaaagaggttgcacctagtacggaattgcgtaaatggtttggtcatgatccagagcgctttgatgcgttttgtcaaagatacctagcagaactaaaaaagaagccagccgatgatgcctttagtgcattgcagcaaatagtaaaagaccataaaaccgtgacattggtttatggtgcaaaagatgaaacacataatcaagcggttgtattagctgaagaattgaaaaaactgccattgaagtaaaatcttcaatggcagtttttgtattaacgagagacacttttacgcatagctcgttttcttttttcttcatttagtgcttgttgttcgtcaattggatcgatcacttgttttttgacagtcatgactacgctagcagctgctgcgatagttgctactgtaccaactaagaaacctgaaagaaatcgtttcattcttctccacctcgcctttatctatttatttctattatgaaacaaaagtacaaaaatatcaaaaataagcccttgtatcgcgagtaaaggattgataaaatttagtaaatattttataataaatttactaaatgaaatgaaggagcgaaaaagatggaacagctacaacaaatttttgcagaaaaattcggtgaaaaaggcacaggatcgtattttgcaccaggacgaatcaacttgatcggggaacatacagattataatggcgggtatgtctttccagcctctatcacgataggaacgtatggtgtagcacgaaaacgggcagataagcaaatacgtctttattcggaaaacttccctgaaaaggggatcatcactttttccttagacgatttggagtaccgcaaagaagacgactggaccaattatcctaaaggtgtgattcgctatttgaaagcagcgggtcatgcaatcgactctggtattgaaatcgctttttatggcaatattcctaatggtgccggcttgtcttcttcagcctccattgaattattgacaggagtgattcttgatgatttgttcggattggcgatcgaacgtttagagttgattttgacagggaaaaaagttgagaatgaatttattggggttaattcaggtatcatggatcaatttgctataggaatgggaaaaaaagaccatgcattactgctagataccaacactttagcttatgaccttgtacctgcagaatttggggactatgtcgtagctatcatgaatacaaacaagcggcgggaattggcagattcaaaatacaacgagcgccgtggggagtgtgaagaagcattaaaacgacttcaaacgaaactgaaaatccaatcgcttggtgaattggacgaagcaacattctttgcacatacttcactgattgaagatccaaccttgatcaagcgcgcaaaacatgctgtaactgagaatcagcgtaccttaaaagctaaagcggcattagaagcgggagatttagaatcttttggtcatctgttagatgcttctcatgcttctttaagagatgattatgaagttacgggtatcgagttagacactttggtggcagcggcacaagaacagccagcagttttgggagcccgaatgacaggggctggatttggtggttgtgcaatcgctttggtgaaaaaaagcgagtgggaagcttttgcaacggctgtcaaagaaagctatcgtgaaaaaatcggctatgagacagatatttaccaagcaagcattgatgatggcgcgcgaaaactgtagaatgtaagacggattcattgaataaatgaaagaaaaggatgattaagaatggctattttagtattaggtggcgccggatatatcggctctcatgcagttgatcaattgattacgaaaggataccaagccgttgtcgtggataaccttttaacaggtcatcgtcaagcgatccatccagaggctgttttctacgaaggagatattcgagacaaagcatttttgcaaagcgtttttgagaaagaaacgattgatggcgtgatccattttgccgcaagctctcttgtcggtgaatcagttgagaaaccgttgaaatacttcaacaacaatgtgtatgggatgcaggtattattagaagtaatgaaagacaacaacgttgatcatattgtcttttcttctactgcagcgacttatggcgagccagaacaaagcccaatcacagaagaaacacctacaaatcccaaaaatccttatggggaaagcaaactcatgatggaaaaaatgatgcgttggtgtgatgaagcttacggcatgaaatacgtcgctttacgctactttaatgttgcaggagctaaatcagatgcttcaatcggggaagaccatgatcctgagactcatttagttccactcatcttgcaagtcgctttaggtcagcgtcaggagctagcaattttcggtgatgactatgatacgccagatggaacttgtatcagagactacgtacacgtagaagatctatgcaacgcccacattttagcattagaatatttgaaaaaaggcaatcctagcaatgttttcaatcttggcagcaacaatggctactcagtcaaagaaatgttggatgccgcgcgtactgttacgcaaaaagatattccagcgaaagtagcaccgcgacgtgccggagatccgggaacattggtcgcttctagtgataaagcaaaagcggtgttaggttgggaacctagttacaccgatgtgaaacaaataattgaaacagcttggaattggcacgttagccatccagaaggttatcaagactaggaggcaacaaaatgacgctcagtcaaacaatctgtgatttcgtgacattagcgatccaggctggtggttggatggaaatggatcgtatttatttacaaaataggatccttggtatgattggtgaagaagactttgaatcagctactgtacgaccggtcgaagaatcagccgtggtattgatggatcaattggtcactcaagcaaaaaaaaatcaggtgatcggcgaggcacttgctgataccgaaatccttgaagcgcaattgatggatttcttgacgccaccgccttctgtggtcaatgctttctttgcccagcactatgcaaaagacccacaagaggcaacggattatttttaccatttgtgtcagcaaaatgattacatcaagactcgagccatcaagaaaaatattgtttttccggtaatgaccgagtatggagaattagagatcacgatcaatctatccaaacccgaaaaagatccgaaagaaatcgctgcgcagcgagcagcagcagcgatcgattatcctaaatgtctcctttgtttggaaaatgaaggttataaagggcggctgaattacccggctcgaacaaatcatcgcattattcggatgaatctggacggcgaagcgtgggggcttcagtactctccgtatgcttattacaatgagcattccatctttttgtctttagagcatcgtccgatgaagatcacgcgcaaaacctttgatcgtctattgcaaatcattgaggttctgcctcactattttgtcggttcaaatgctgatttgccaatcgtaggtggatcgatcttgtcccacgatcattatcaaggtggacggcatacatttgcgatggcaaaagcacccattgagaaaacattcaaactaactggttttgacgagctaacggtgggaatcgttaaatggccgctttcggttattcggattcaaggtcgagacaagcaaaaagtggctgctgcttctgattatattttggcacaatggaaagagtactcagatccttccgtttcgatcaatgcttattcagaagatggcacaccgcaccacaccatcacaccaattgctcgaaaacagggcgaatactttgaaatggatcttgttcttcgggataacaatgtttctgacgaacatcctgatggtatttttcatcctcataaagatgttcagcatatcaaaaaagaaaacattgggttaatcgaggtgatgggattagcggtcttgcctccacgtttagcaacggagttagaagaagtgagggcctatcttcttgatcagccaaatcaaattgctgcttatcatattccgtgggcacaagagatgaaggaaacctacaccatcactgaggagaatgtaacagagattgtttatcaagaagttggtgggatttttgcaaaagttttggaatacgcaggagttttcaagcgagatgcatccggtcaggctgcattcatgcgttttatcaataaactttgaagttattgagatgactttgaaagaatggaggcgcgggaatggctacaattaaagatattgctgaacaggcaggcgtttcaccagcgactgtttctcgtgtcctcaattatgacagtgagttagccgtcagttcagaaaccaaagaaaaaatattcaaaaccgccgaagcactgaactatacaaagcataaaaagaaaagccaagtcgaaaacggtcggattcgtttgattcagtggtttgataccgaagaagaactggccgatctttactatttagctattcggcttgggattgagaacaagacggaagaattggggattcgcttgttaaaagaatcgtttgcttctatcagtgagacccaagtagatggaacgattgctttaggaaaatttgatgcccagcagatcgcacaattaaaaaagacgcagcctcatctgctactcgttgattttgacgggctgtcggctggagtggattcattggtagtcgattttcagcaagcagtggatttggtcattgatcattttgttgctaaaggacatcaaaaaatcggtatcttatctggtattgaatttacaaaaggaagtcgacaagaaattgaagatccgcggctgacgctattcaaggaacgactgacacgcttgcgtctttatgacgaagggtatcacattgcagcagcgtttactgtcgaagatggatatcaggcaatgaaacagttcttgcaagacgccttgccactgcctactgcgttatttgcttccagcgatgctttagccatcggagcactgcgggcactgcaggaagaaaagattcgtgtgccagaagatatctccttgatcggctttaacgatgtcagtgttgccaagtatgtttttccaaccctttcgacaatcaaagttcatacggagtggatgggagagttggctgtaaccacactacttgagatcatcaagaatccagctcctgttccgcgaaaggtcaccatcgcaacggagttgattaaacgtcaatctacgaatcaatgatggggaagttcatctgcaacaaatagaaatgtcctgagaatctatgggaaaaagtctccagtaatggaacagttttccgtcgcagtcagaaactgtcgcggctgccatagattctttggccatttttttagttcaccagtaaccatgcacctatgaaagcaaataagcaaagtttggcattttatcagaatatggtaaaatatgagtgagttttttgattggggagaaaaagcaatgaaaacattagcgatcgatacatcaaatcaaacattggccattgcagtcatggatggtcaggagatcctaggacaaagtcagacgatggctatcaaaaatcacagcagtgcattgatgccggcaatcgatttattgatgcaatctgtgggggtattgccgcagcagttagagcgaatcgcagttgcccaaggtccgggatcttatacaggattgcggatcggtgtcacgaccgctaaaacattagccgatacattacatatcccattggtgggcgtgtcgagtttgaagaacatagctgcgaattgtgttggggttttgaaagtgatcgtgccattatttgacgcacgtcgcaacaatgtctatgctggtggctatcgttggcaggaaggggagctgcagtcagtgatccctgaccagcatgtggcattaccgacattgttgcatgcactagctgagttgcacacagaggtactttttgttggcgctgatgctgcaaaatttgccccgcaaatcactgaagccatgccgtctgcacagatcaatcacgtttctttgtggaattatccgaatggcgtcgtgttggcagaattaagtgaaacagaggaacccgtttcgtcgatccatgattttgtgccagagtatttgaaacttgttgaagcggaagaaaagtggttggcatctcatactccaggagcggatacgtatgttgaaaaaatttaaatctttcaaaggaaagctgcccctttttcgtaaagttcaatacccagaacagacgaaaacgattcaggatgaaacgtatgtgattcgtgaaatcgtcggcgaagatatcaaagagttactgcaagtggaacgattggtgtatgccggcgagctgccttggaccaagagcgcgtttctttcagagatttattcgcgatttaagcatttgtacttgtgtatcttacaaaatgagcgcatgatcggttttgcgggcgttcgtttgttgggagaagatgctcatattaccaatattgctgttatacctgaatatcaaggccgaggtgtcggctcttttttgttgactgaaatcgaacagtatgcgcgaaaaaacaaatgtgaccgaatttcgttagaagtgcgtttaagtaatcgtgacgctcagcgactttatcgacagctgggctttgtctcgcgagcgatcaaaactgcctactatacagaaggaaatgaagatgcattggatatggtgaaatttttaaatgaataaactgttgaataaagaagaattgcctgcaaaaagtgaagagctgttatggcaattggcagaagcgagttaccaagatggctctccctggacttgtgaacaattcaagcaggatttggctgctgttgacagtcactatttagtactccagccaatggaggcatttgttagttaccgtcgggttttagatgaagctgaaatctttaatctcgcagtcttaccggaaaaaaaaggacagggattggggaaactcttgctgcaagctgttattcagtcttgtcaatctgctggcgtcgaaaggatttttctagaagtgcgggtccgtaattttccagcacaagccttatacctgcgaatgggttttgaaatcattgggcggcgcaaaaattattatagtcatcctcaagaggatgcattgatcatggaaaagaaagtgaggccagcatcaatcaaatgaatgaattgattttagccattgaaagcagctgcgacgaaacaagtgtcgctgtcataaagaacggggacacgattttaagcaatatcgtggcttctcaaattaaaagtcatcaacgttttggtggcgttgtcccagaagtagctagtcgacatcatgtggagcagattactctttgtttagaagaggcactgaaacaagcagaagtgacaccagaagacttatccgctgtagcggtcacgtacggtccaggcttagtgggggcgttgctgatcggtctttcggcagccaaagcgtttgcctgggcgcatggattacccttgttgccagtcaatcatatggcggggcatatctatgcggcccgttttgtcaaacctctgacctttccattgcttgccttgctagtgagcggtggacatacggagttagtttatatgacagaagatggttcctttgagattattggcgagacacgtgacgatgctgcaggagaagcatatgacaaggtaggacgagtcttaggactttcttatcctagcggaaaagaaatcgatcgtttggcgcatttaggtgaggacacgtaccattttcccagagcaatgattcatgaagacaattttgattttagttttagcggattaaagagtgcctttattaattttgtccataatgcgcagcaacgaggagaaacattggacgaagccaaccttgctgctagttttcaagcaagtgtcgtagaagttttggtcactaagacgattcgcgcctgcaagacttatcctgttaaccaattgattgttgcaggtggcgttgctgcaaaccaaggcctgcgtcaggcactagatgaagcaatgagtgacctgcctgagattgacttgattattccacctttgcgtttatgtggcgataatgcggcaatgatcggggcctttgggcatattttgttagaaaaaaaacagtttgccccactatctttgaatgctgtgccaagcctaagttttggtcatgaaatgaaataatcaagcatttgctgctcaacattacagagaagaccgtggcgtcatcgggatacgaatccgaatggcagcccacggtcttttgtttaattatttggataaaattgattaaaaatacgtaaaacttgtatatattgaataaaaattataaaagatgtatactggctaaaaaacataggcaagaaagggtgcaaaagaaatgaaatccgtttttaaaggtcgcagttttttagcagaaaaagattttaccagagatgaattgcagtatctgatcgatttttcattacatgtaaaagaattaaagcaaaagaatatcccgcatcgttatttggaaggaaaaaatgtcgctcttttgtttgaaaaaaattctactcggacacgagctgcctttaccgttgctgccgttgatctaggagcgcatccggaatttttaggagcaaacgatatccagatgggatcaaaagaatctgttgaggactctgcaaaagtatttggtcggatgtttgatgggatcgaatatcgaggatttagccaaagaatcgttgaagacttggcgaaatattctggtgtacctgtctggaatggattgtctgacatgtggcacccgacacagatgatcgcagactttatgacgattcaagaaaattttggcagtcttgaaggtctgacgatcgcttactgcggcgatggaagaaataacgttgcgcaatccttacttgtgactagcaggattctcggtgttgctattcgaatcatcgcaccaaaagaattacagccggaacagcaagtcatcgagctggcagagcaatttgcccaagcatcacaagccgaaattttgattacagatgatgtggcagctgtagcaggagcagacgttgtttataccgatgtatgggtttcaatgggagaagaagcaaaatttaaagaacgaatcgacttgctgatgccttaccaagtaaatgccgaattaatgaaaaaaaccaataatgaacaagccattttcctccattgtttaccagcttttcatgatacacaaaccaaatatggggccaaaatcgctgctgattttggcttgaaggagatggaagtgacgaatgacgtttttcacagcaagcaagcgcgccagttcgatcaagcagaaaatcgccttcactctatcaaagccattatggctgtcacccttggagatctatttattccaaaggtttaactagcgaaatccatgcaaaggcgaaaaaccggctagccaaaccgattattttttgttatactttctgggaacaaaatagtagataatcgatgagcaagaagagtagcttttgtttttcagcgagttcgggaaggtgtgagccgaacaatcaagaaagtgaagcgcacttgtgagattttgcctagcaaacggaattctgccgttatcagaaataagtaggtcttttaagaatcattccttaaaggacaaatagagtggtaccgcgggaaatctcgtctctagtgcatgtgatgcactagagactttttttagttgttccgcatgtacattcgctgggcattgctttcgtatcgaaacaaatggagggaaagaaaatgaataataaacaaatcgttgcacaagctatttatgccgctgtcaaagaagatttgactttagaacaagtcagtcaattgttagaaaatcctaaaactgctgaacacggagacgttgcttttcctgcctttgctttagccaaagtctatcgcaaagcaccgcaacagatcgctagcgagctggcggaaaaaattgatccagcttcttttgaaaaaatcgaagtcgtgggtccatacttgaacttttttatgaataaagaagtgatcagcgaacacgtcttacaaaccgtcttgaaggaaaaaaatcattatggagatcaatcaattggcaatcagcaggcggttccgattgatatgtcttcaccaaacattgcgaaaccaatctccatgggccatttgcgttcgacggtgatcggtaattcgattggctttattcttgaaaaaatcggttatcagccaattcggatcaatcatttaggagactggggaactcaatttgggaaattgatcgtcgcctataaaaaatggggttctgaagaagcagttaaaaaagaaccaatcaatgaactcttgcgtttatatgttgaattccatgaacaagcagaaaatgataaagcgttggaagatgaagctcgggcatggttcaagaagctagaagacggtgatcaagaagcaaccgaattatggcaatggttccgcgatgagtcattgcaagagttcaacaaaatctatgacatgctggaagtaagttttgattcattgaatggggaagccttctacaatgataaaatgacggaagtcgttgaacttttggaagaaaaacatttattacaagaagatcaaggcgcagaaatcgttgatttgactgcctatgatctcaatccagcgttgatccgcaaatctgacggcgcaacattatatatcactcgggatatggcggcagcattgtaccgcaaacggacttataactttgctaagtctctgtatgttgtcggtaacgaacaaagctatcattttaagcaattgaaagcagttcttaaagaaatgggcttcgattggtcagatgatatgcaccacatcccatttggtttgatcaccaaagatggtaagaagctgtctactcgtaaaggaaaaatcgttttattagaagaagtattgaatgaagccatcgaatctgcgaaagaacaaatcacagaaaaaaatccaggcttagcgaacaaagatgaagtggcaaaacaagtgggtgtcggtgcggtcgtctttcatgatttaaaaaatgatcgcctgaacaacttcgatttcacattggaagaagtcgttcgttttgaaggagaaaccggaccttatgtccaatattctcatgcacgggcgatgagcattttagaaaaagcacaatttgatcctgccaatgcgcaagctcttgctttgaatgatgcagagagctgggaagtgatcaagttgatccaacgctacccagaaactatcttacaggctgcagataaatatgagccatcagtgattgctaaacatgcgatcaaattagcgcaagccttcaataaatactatgcaaatgtcaagattttagcagaagatgcgcaaaaagatgctcgattggcattggtttacgctgtaacagtcttgttaaaagaagatttgcgtctgttaggattacatgcacctgataaaatgtaaataaaaaaaaagataccaacggcagcctatatgcttgccactggtatctttttttcgattctttagagaatagcatgggacttgatatattcagtcagcttgatggcatcttcatttgtacgggaaataacggctactgtatcaaagccggcgagagaacaaactttctcaggcatcgaaacttcatctaaagccgctgccaataaaggtgcattgtcagggatcgtattgattagcgtcataaattgaacacgatccactttggtgacgacatcttccagcatgtgaatcagccgttgttcttccgctttttcattttcttgagtattcattccttgaaagagaacaaattttgtttgtccagtctcatcaggctgtttgacaatttttagatcacggatatcgcgggagatcgttgcctgcgtagcggttactccttgtgcttcgagcaactgcaacagttcttcttgagttcccacactatgttctgcaataatctgtttgatcaataaatgccggtcggatttacgcataaatagactcctttaattgaattcttcagcattatcatagcagaaaaaggattaaaaacctaggctttagtcagactgaacacccgttgtttgtaagaaaaaaatgtaaaagtaaacagctaggtttatgaggaaaagcagttgcaattctttagtagctactgtatactgtttaaggcgtgagttttttgactccgcaaatccacatcttgttccatctgcgaagcggtgctgataatcagttcttcgaagagctaaagagcaagagaggaaatcaaaaaccaaattggaggaaacacatcatggcagtaatctcaatgaaacaattgctagaagccggcgtacactttggacaccaaacacgtcgctggaacccaaaaatgaagaaatatatcttcacagaaagaaacggtatctacatcatcgacttacaaaaaactgttaagttagtagatgcagcatacgactacatgaaaaacgttgctgaagaaggcggagttgctttgttcgtaggaacaaaaaaacaagctcaagaagcaatcaaagaagaagcaatccgttcaggtcaatactacgtaaaccatcgttggttaggtggaacattgacgaactgggaaactatccaaaaacgtgttgctcgcttgaaacaaatcaacaaaatggaagaagatggcacatttgatgtccttcctaaaaaagaagtcgttggtttgaacaaagaacgcgaacgtcttgaaaaattcttaggcggtatcgctgatatgccaagaattccagatgtaatgtacgttgttgacccacgcaaagaacgcattgcgatccaagaagcacgtaaattaaatatcccaatcgtagcgatggttgatacaaactgtgatccagatgagatcgacgtagttatcccatcaaacgacgatgcgattcgtgccgttaaattgatcactgctaaaatggcagatgcatttatcgaaggcaaccaaggcgaagaccaagtagttgaagaagatttttctgctgaatcaacagaaaatgctacttcaatcgaagaaatcgttgatgttgtcgaaggcgacaatgtatcagctgaataagaaatgatggagctgtttcaaaggctaggcgccaagcctcactctcctttgaaacagcttttttaaaaggcaagttcaggcttgttaaatgacatttaggaggaaaacaaaaaatggcagaagtaacagctaaattagtaaaagaattgcgcgacatgactggtgtaggtatgatggatgcaaaacgtgccttagttgaagtcgaaggagatatcgaaaaagccgttgatctattacgtgaaaaaggaatggctaaagctgcaaagaaaaatgatcggattgctgctgaaggattggcatctgttgctatcaacgggaatgctgctgcaatcgttgaagtaaactctgaaacagacttcgtttctaaaaacgaaatgttccaagatttagttaaagaaatcgcagaagtaatcgctgcaaacaaacctgctgacatggaagctgctttgcagttggaaacatcaaaaggtaaaatggaagcagcattgatcgaagcaactcaagttatcggtgaaaaaatcagcttccgtcgttttgaagttgttgaaaaagatgacaactctgctttcggtggctacttgcacatgggcggacgtatcgctgtcttgactgttcttgaaggaacaacagacgaatcagttgcaaaagatgtcgctatgcacgttgctgcaatcaatcctcgctatgtgaatgaatctcaaatctcacaagaagaattggatcacgaaaaacaagttttgactgaacaagcattgaacgaaggcaaaccagccaacatcgttgaaaaaatggttgaaggccgtttgaaaaaattcaaagcagaaatcgctttggttgaccaaccattcgttaaagatcctgacatgactgttgaaaaatttgttgcttcaaaaggcgcaacagtgaaatcatttgttcgttttgaagtcggcgaaggtatcgaaaaacgcgaagataactttgtagaagaagttatgagccaagtcaaaaaataattctgttcctcgaacagatgggaacgcatggaagtgcgctccctttttttaagcaaaaaccgattttcaaaaaaattgcacaaattcaaacagaatggcgccaatatgctacaatagtattggagaatgtacggaggaatcatcatgggtaaaccaaaatatcaacgtgttgtgttaaaattgagcggcgaagcattggcaggggatgaaggatttggtatcaaaccgccaacgatccaagaaatcgtcaaagagatcaaagaagtccatgaacttggtgttgaaatggcgatcgtagtaggcggtggtaacatttggcgtggtcagattggtgcacaaatgggcatggaacgagcgcaagcagactatatgggaatgttggcaacggtcatgaatgcattggcgttgcaagacactcttgagaacgctggcgtaccgactcgcgtccaaacatcgatcgaaatgcgccaaatcgcagaaccttatattcgccgtcgggcagaacgtcatctagaaaaagggcgtgtagtgatctttgctggcggcacagggaatccttatttctcaacagatactacggctgccttaagagcagctgaaatcaatgcagatgtgatcttgatggcaaaaaataacgtcgatggtgtctactcagcagatccaaaaatcgatcaaagtgcagtgaagtttgaagagcttacgcatctagaagtgatttcgaaaggattgcaagtcatggattccactgcaagctcattaagcatggataatgatattccgttagttgtctttaatttaaatgaacaaggaaatattcgccgtgcaatcttaggagaacatattggaacgacagtaagggggaaatagaatggctgacaaaattttaacagaagcaaaagataaaatgaaaaaagcagcagaaaacttgcagcgcgagttaggacaaattcgtgctggccgtgcgaacgcaagtattttagaccgtgtgatggtaacctactatggtgttccaacaccactaaatcaaatggcatcaatcacgattcctgaagcgcgtattttgatgattacgcctttcgacaaaacaatgatccaagaagtcgaaaaagcgatcatgcaaagcgacatcggtatcacacctgctaatgatggtacagtaatccgtttagtcattccgcaattgacggaagagcgccggaaagaattggcaaaagatgtgaaaaaagaagcggagaatgcgaaaattgctgtccgtaatatccgtcgtgatgcgatggatgcttacaagaagcaagaaaaatctggcgatatcacggtcgatgatttaagagaatcagaaaaagaagttcaaacattgacagacaacagtattaaagaaatcgatcagatcgcagctgaaaaagaacaagaattattagaagtataagaagcaggggcgcacaagcgccctttttttattcctaacaaagagaaaatgtttttgtttttctttaatatagatttctttttttacttttcataggcaagaaatatgattattgttataatgaaaaagatgaattttacgaaatggaagaggagcgaatcatatgttgcgtttttttccacaaaaagacaaatatgttaaggaagaaactgaatacgaacttgatccggcattacctgtgcctcagcatatcgcgatcattatggacggaaatggccgctgggctcagaatcggcgtttaccgcgggtggcagggcacaaagaagggatggagacagtgaagacgatcacgacccatgcctcgcggcttggagtcaaagtcttgacattgtacgcattctcaacggaaaattggaaacgaccaaatgaagaagtcgattacttgatgcaattgccagttgatttttttgacacgtttgtaccagagctgatcaaagaaaatgtgaaggtccatgtgatgggctttactgaatatttgcctgctcacactcaagatgctgtcaatcgtgccatcgaacagaccaaggagaatacaggaatggtcctgaatttcgctttgaactatggcagtcgtgctgaaatgctgcaggcgatccaaaagctgtatgaagaactagaccacacacaggagacggtggaaatcaccgaagaaatgatggaccagcatctcatgactggtttcttgcctgctgcacttcgcgatcctgaattggtgattcgaacgagtggtgaagaacggatcagtaattttcttctttggcaaattgcttatagcgagctctttttcactaaagcattatggcctgactttgatgcccaattgttagaagctgccatcggcagttttcaacagcgaaatcggcgctttggcgggttgaacaagaaggaggacaaaaagtgaaacaacgtgtgatcaccgcagtggtggcattagcattttttttaccagttatttatgtcggtggaatagccatcgagttgacggcagctttacttgccggaattggtgtgtttgaattatttcggatgaaaggactagcggttctcagttttgaaggggtgttatcgattcttggggctgtgatcttagtcttacctaaagatccttggtttgctttcttaccagcaaatacagataaaagtgctttgttttatctgattgtcttgttgttgctagggatcgctgtcgtttccaaaaatatgtacaccattgatgaagcaggtttccccgttttagtcagtctgtatgtgggtgtcggctttgaacgtttcttgacggctagattagtaccaaacggattagttgtgctgatttttggcttgtttattgtttgggcgacagatattggtgcttatatggttggccgccgattcggcgcacataagctatggccggagatctcaccgaacaagaccgttgaaggggcattgggcggaattgtttcggcagtcgttgtggcagctctttatttgttggcattcccaggcaacgattactttggccatggaagtctgatcatgatcgtattgacgattattttttcgattgctggtcagtttggtgaccttgtcgaatcagctatcaagcgacactacggagtaaaagattcaggcaatattttgcctggccacggcgggattcttgatcgttttgatagtatgctgtttgtttttccaatcatgtacttattaggtgttttctaaagcaatcatttagttagtctagataaacgagcaataatcacttgcttgactagataagtgctaggtcattaatttgtttgatcagctccgcagaaagaagacaatttttaacctcattttaaccttatttcaacctctaaatgaagcctgttttcacgggaccagacatttagaggttttttagttctcgactacttggcggtcgaagcttttttgacggacccctgtgaagaatgcgaggataaggaaaaaagaacactcttcctgttaaggaatgtgttgagagaaagagccacagtctttttatgcgtgttagagcttggttctttaaattcttgttacaataacgccggaagttcctcattaggtgtgggtgtgataaaataaagaaaggtttcccctttagcaagagggaacagtgaaagcgaggaaacagaatgaaaacgattcttgtgtttattatcatattttctgttgtggtcgtaatccacgaatttggacactacttctttgccaaacgtgcagggattttagttcgggaatttgccattggaatgggtccaaagctttttgcccatcaaggaaaagatggaacgacttacacgattcgaatgttaccattaggtggctatgttcaaatggcaggctggggcgaagatgagacagagctgacaccaggtatgccgatctcacttgtgcaagacaaggatggaaaagtcatcaagatcaatactagcaaaaaggtgcagttgcctcatgcgattccgatggaagtggtagactttgatctcgaagaaaagttgacgattgcagggtacatcaatggaaatgaacaagaaaaagtcgcttatgcggtcgatcatgatgcaactattattcatgaagacggtgtggaagtaaggattgcaccgaaagatgttcaatttcagtcagcgaaactttggcagcgaatgttgaccaattttgctggaccgatgaataacttcatcttagcttttgttttattcacagggttagtgtttgcacagggtggtgtacaagatgtgaatacgaccagcatctctggtatccaaaatggttcaccagccgctgaggcaggcttgaaagatggcgatgagatcttagcagtcaatggcaagacagtatccaactggcaggaattgagcagtgagatccaaaattatcctgacacgaagatcccccttgaagtgaagcggggaagtgatacattaacgattgaagcaacgccagaagggaaatatgctgaaggagaaaaagtaggatttatgggaatcagtcctggcttgaaaacaagtcttggtgacaagctattaggtggcttgaaattgaccttcaacaatgctttactgattttccgagctgtcggtaatttgatcgtacaaccagatctggacaaattaggcggtccggtggccattttccaattgtcctcacaagcagcctcacaaggggtagcttctgtcgtcatgatgatggcggcgatctccatcaacttaggaatcttcaatttgttgcctattccaggattggatggcggcaaactcgttttgaacattcttgaaggtgtccgaggtaaaccgatcagtcaagaaaaagaaggaatcatcacgttaattgggtttggttttttgatgttgctgatggtgttagtgacttggaatgatattcagcgctttttcttttgattagaggaagcagctgatatgggccaagcagggtgtatggtatagcaaagtgtttgcagcaaaggagaaaaaaatgaagcagtcgaaactgtttattccgacattgcgggaaataccaagtgatgcggaaacattgagtcatcaacttttagttagagccggttatattcggcaagtggcagcaggcatctacatgtatttgcctttagcccagcgggtgttggagaaaattaaaaaattgatgcgggaagaattagccaaaattgatgcagtagaaatgacgatgccagttttattgcccttggaactatggcaaagtactgggcgagacgggctttatgggcgctcactgtatcagttaacggatcgaaacgagcgggagtatgtcttggggccaacccatgaagagccttttacggaattgatcaaaagtgagatctcttcctacaaacgtctgccgatcagtttgtatcagattcagtcaaaataccgagacgaacaacgtccgcgcttcggtttgattcgcagtcgcgaattcatcatgcaagacggctactcatttcatgccgatgagtcaagtttagatacgacttatcgtcggtatgaagcagcctatcacgcgattttgcagcgttgtggtctggagtatcgcgcagtgattggtgataacggtctgatgggagggcatgattccaaagaattcatggcactgtcgcagattggtgaagaactaatttgctactcaacggaaagcgactacgtggcgaattggaaaatggccacaagtttgtatgtatcaaagaaatctcacgaaacctttcttgagcgcgcagagttgcaggttgatccatcttattctctggaagaagtagctgcagcttgtgagagtgacttgactaagatcgttcagtcctttcttttgtttgctgatggagaaccggtcatgattcttctacgtggcgatcatcaattgaacgaagcaaaagtcaaaaattttctagaagccgatcaattgaaaatagctacaccagaagaattacgttgtcatctgcaaactgaagcaatcagtcccattgcgctgccggaaaatgtccgcttatatgctgatcagcatgtacaagatttagcaaatgtgatcgtctttggaaatcaaccgggccattactatcaaaacgcaaatgtaggacgagatttttccccattggcatttgctgattttcgattggtgcaagaaggtgatccttctccagatggcaaaggggtcctaactttcacacgaggaatcgaagttggccacattttcaagctaggaaccaaatacagtgaaagacttggtgcgacagttgtcgatgagaacggtcaggagacgccagtcatgatggggtgttatggcatcggtgtatctcgtcttctatcaacaatcgttgaacagcacggcaatgaagagggaatcgattggccgaaagagattgcaccctatgatatccatattattcaaaccacaatggaagactcgtatcaaactgctttgtgcgaggaagtagagcaagcgatgcttgctgtcggttatgaagttttagtagatgatcgcaacgaacgtgctggtgtcaaatttgcggatgcggatttgataggctgtccgattcgattgaccattggcaacaaagcgacagaagggattgtcgaaataaaaatcaaacacacaaatgcaaccgttgaagttcgtaaagaggaagtggctacgacattaacgatcttgttgactgcatctgaatgatccgtgacaaaaatcgaggaagggggagccctttctcgattttttaatgaaagacaaaagaaaaagaggtatactaattaatactgagaaaaaggaggatggtcaattgtcaaaagaaagagagacctttgagattttattagagcaaatcaatgctggtcctaatttacgccaacatcctttgatacagaccgctcaaatcaaacaagtcgtggtccatcgccagtcaaaagcttggacattttacttgcagtttgatacattgctacccgttatggtgtatcaatcgttcaaacaacatttggaactggcctttaaggaaatcgctgcggtgcgaatgatcattgaagccaaggataatgccttcgatcaacaactgatccaagagtactggccattagcactcgcaaatcaaaactgtgatcgtccactagtacagcaagtcattaagaatcagctaccggtagtgaatgagaaaaaagtgatcctgcctgttaccaatgaagcggtaatcgcgattttgcagcaacaatatttaccaatcattgaagaaaactatcaaacatttggttttcaaaaatttcgtatcattcctgaaatggatgccgaacaagcagaagaagctttaaaagaattggaagctcgtaaagaagaacagactgctgctttccaattacaggctgctgagaacttgatcgcccatgaacagcggaaaaaagaagtgaaagctgttgaatttgacggtccgattgcattgggaaggaatattccagccgatgaacccgttaccccaatgattaatatcattgaggaagaacgccgtgtgacgatccaaggatatgtctttgataaagaagttcgggaattacgttcaaagcggaagatcttgattctgaaaatcacggattatacgtcatctttcagtgtcaaaaagttctccaataatgaaaaagatgaacaaatctttgaggcaatcgccaaaggcagctgggtaaaagttcgcggaagcgtgcaggaagatacctttatgcgagatcttgttatgaatgctcaagacttgattgaggtaaaacacgagattcggaaagactatgcacctgaaggagaaaaacgggtggaactccatcttcattcaaatatgagtacgatggatgccacgaataatatcagtgatttagttgcacaagctggaaaatggggacataaggcgatcgctattacggaccatggtggcgcgcaagctttcccagatgcccatcatgcgggtgaaaaagctggtgttaagattttatatggggttgaagccaatatcgttgatgatggcgttgcagtggcttataaccctaaaccagttcctttgacggatgccacgtatattgtgtttgacgtggaaacgacggggctatctgccgtttatgatacaattatcgaattagcggctgtccgcatgcataaaggcaatgtggaaggctcatttgatgaattcattgatccaggacacccattgtctcgcaccaccgtagagcttacagggatcacggatgaaatggttcgcggttctaaatcagaagaagaagtattgcgactctttagagagttttctgaaggagcaatcttggttgcccacaatgcttctttcgatatgggctttttaaatacgagttatcgaaaatatgggattccagaagccgaaaatccagttattgatacattagaactggcacgttacttatatcctgagttcaaacgttttggtctaggcgtcttatctaaaaaattcggcgtcagcttagaacagcatcaccgagcgatctatgatgcggaagccacgggccatttagcttggatctttgtcaaagaagcgatggaaaagcatggcatgctgctgcatgaagacttgaaccgccatgtgggaggagagaactccttcaaagcggcgcgaccattccatgcgacgatcttggcgaagacgcaagccggattaaaaaatttatttaaattgatctcgatgtcgaacgtgaaatatttccatgacaaagtcccaagaattcctcgctcggaattggtgaagctgcgggaaggattacttgtaggaaccgcctgtgacaagggagaagtctttgtcgccatgatgcaaaaaggggtggatgctgcccgtaaattagcagagttctacgattatattgaagtcatgcccaaagaagtttacgctcatttgattgagaccgaacttgttaagaatgaatcagacctagaagacattattcgcaacctgatcgagatcgggaacgaattaggcaaagtggtggtagctacagggaatgttcattatttgaatgaagaagatgcgatctatcgtaagattttgatcaattcaatggggggagccaatcctctgaatcgccatagtctcccagctgttcactttcggacgacagatgagatgctgaccgcttttcaatttttaggcccagatacagccaaagaaatcgtcgtgacaaaccccaacaaaattgcggatatgtgtgaaaaggtcattccagtcaaggatgatttgtatacgccaaaaatcccaggttccgagcaagaaatcacagatctaagttacaatcgtgccaaagaattatatggggatcctttgcctgagatcgttgaaaagcgattgaaaaaagaattagattccattatcggaaatggcttctccgtgatttacctgatctcccaaaaactggtacacaagagcaatgaagatggctacttggtgggctcgcggggatctgtcggttccagttttgtcgcaacgatgacggggatcactgaagtgaatccattagctcctcattattattgcccagactgtcagtactcggagttttatgaggacgggtcttatggttctggctatgatatgccagaaaaaaaatgtccgaaatgcggcacccgactaaacaaggacggtcatgacattccgtttgaaaccttcttaggtttccatggagataaagtccccgatatcgatttgaacttctctggggaataccagcccgaagcgcacaattatacaaaggttcttttcggagaagattatgtttaccgtgcaggaacgatcggtacggtagcagacaaaaccgcattcggttttgtaaaagggtttgagcgggatcacaatcttcattatcgtgcagcagaagtggaccgattggccaaaggggctaccggagtgaagcgcaccaccggacagcatccaggggggatcattgtaatccccgattatatggatgtctatgatttcacaccgattcaatacccagccgatgatatgaattctgaatggaagacgacacactttgatttccactcgatccatgacaatattttgaaactggatattttaggacatgatgatccgacagtgattcggatgttacaggacttatctggaattgatccaaaaacgatccctaccgatgatccagaagttatgcgtatttttggcggaacggatgttttaggtgtaacagaagagcaaatttattctaaaactggtaccttagggattcctgaatttgggacccgtttcgtacgggggatgttggaacagacccatccgtccaccttcgcagagttgttgcagatttcaggactttcccacggaacggatgtttggctaggaaatgccgaggaactgattcggcgcggtgatgccaacttggcagaagtcattggttgtcgggatgacatcatggtctatctgattcatgcaggattagatgacggtatggctttcaaaatcatggagacggttcgtaaaggacaatggaacaagatcccggatgatttgcgagatacgtatctgcaagcgatgcgggaaaataatgtccctgaatggtatatcgattcttgttctaagatcaagtatatgttccccaaagcccatgcggcagcctatgtattgatggcattgcgggtcgcttacttcaaagtatatttcccaattctgtattactgtgcctatttctctgttcgtgcggacgactttgatttgatcgccatgtcaaaaggcaaagaagcggtaaaagagcggatgcaagaaatcaatgacaaaggcatggatgcatcgacaaaagaaaaaaacttgctgactgttttggaattggccaatgaaatgttggaaagaggctatgaatttggcatgatcgatttatataaatcggatgctgagaattttgtgatcgatggcaacaagctgatcgcaccatttcgagctgtaccaagtttaggtctaaacgtagccaaacaaatctgtgaggcccggaaagatggtccgttcttgtccaaagaagatctggccaaccgaggaaaagtttccaaaacattaatcgaatatatgacagacaatggtgtcttgaaagatttaccggatgaaaatcaattgtcgttgtttgatatgctataaggaagaaatttattatcaactataaaaacgattcgcaggcactatctttctcagaaatgataggtcctcgaatcgtttttttgttttatacatcgacacttttgctgcatgtcataataaaaccatcaacaataatggaatgtaaatcatataaatcaaaacggagtagcctaatgaagaagcagcaaactcttcatctccatggtaatttctaaccaggatcggcacagaattttgaacaggcatcgatgcttggatgataaagacttgcaacatcaatgaaggaacctgtatccattgaccaatcagccacacgatcaatggagagaggagaaaacgacctgcgaggacaccggcaagatccttggtcatacgtaaattcttgataccactatagtaaacgatgatcccaatgatgaacatggatagaggcgtggtcaactcagaaagatagcctcctaggcctgcaataaatttcggtaaaggaaaatcgaagagcatccagatcaatccaataataaacccaatcaatgcaggagagaagatttttttcaacacaactaaagggtgaaaggagacttttgcttcttcgaaactagggctgtctcgagcgatttcatagatcccaaccgtccaaaacaaactagtgttgacaatataataaagcaagacataaggaacagccttttcgccaaaaatagccaggttgatcggtaatccaataaaaattgtattggaaaaagtaaacatggtggagaaggatccatgatgagtgggagctacttgaaagaaacgctgccaaagtttactgatcccataagtaatgacaatggataataatggaataatcattccagaaaacaatgaaaggaattcatcgcgggtaaaattcttgatgatattcaaaaacatacttgccggcagtgagagattcaaaacaagttttgaaaaggtatctgctgtacgatttgagaaccattgcttaaaagacaaccagtagccaataaacatcaaactaaaaatcacaaaaatattgctatatgcttggaacatgaactcacctctctttcactatagcgaatcttgattccataatcaattcaatcagaaaagaataccccaaaaaagcaatcaaaaaaactatgaccgagaagagtcggtcatagttctaaatttattttcgttgttgtttgccggcattacggccttttgcatttttatgattcaagttttttggcgttgtaggctgcgtctgctgcgtaggagtgacatctttccgaggcgtcacgaccgttttaggcggattggctttcatttctgcttcaacttgcgcacgaatcttaggtttcatgatgacatttgtaataaaggtttgcaggcagctgaagaccccgccgacaacccagtataacgttacaccagcaggtgcacttaatgacatgaagacaatcatcaatggcgaaacgatcaacattgttttcatcgtttttttctgttcttctgggattccaatggttgaaatatatccttgtatgagatacgaaataccagcaatggctacaaataggaaacttggttgtcctaaggaaatcccaaagaattccgaattttgaatcccttgtgtgtaacgagcagtaaaatacaaagctgaaaatattggcatctgaatcagcagcggcaagcaaccgattccgccaaacatgctgacattattttcagaataaattttttgcatgtctgcttgtgcttgcatttgttcttcacgagtggtcgcttttttcaagttggcttgtgcgatatctacctgcggtttcaagaactgcattttttcactttggatcatcgttttcttcgattgatggatcccaagcggtaagataatgaggcgtacaacgattgtcacagcgataattgcccaaccataagaccaatcgaagttttctaccagcatggtgatcaaattacctaatggtttcactaagaaacgatagatcatgccgttttcattcggtgttccatcagagtttgtgctgacgcatccggataaagtcagtaaaagtcctaacaatccagacgagagcagccatttattcatttttgacattcttttcttcctcttcactataaatttagacaaaaataactatactaaaaaagaccgactatttcaatgtacaaaaggaaattcattgaaaaatcaatctttcgtcgtagatttagtaaccatattcaacatcaaaacttgttctttccttgatagaaggatcttcttggatctttgtacttgtcactttaccagaaggagacggtgaatctttgaccgcttcaacaaaagcgtctacctgtttctcttcgccgatagcttcgatcgttactgaaccatcagattcatttttgacggatccttggatccccatccggtccgctaacaattttgtcgtgtaacgaaaaccgactccttggactctgccttgaacttgaatgcgtatttttttcatcaaatcatccctcgtttcagtcaacctctatagtatatgatagcgtttttctaacgaaagaacaagtttcatcctttgactcatgctataatgaggcgaggtgaacaggatgaaggaaattctttcaaaaaaaaatatattgatcaaagaggtcaaaaaactcgcacaaaaaaaataccgcaatcaaaccaatacgtatataatcgacggttggcatttggtacaagaagccattgcagcatcggcaccgatcaattatctatttgttactgataaaggaatccaagaaaccggcaatcagttaaaagactatcaagacaaagtatttcgtatctccgatgaagtagctgcttttctatcagatttaccgacaccccaagggatctttgcagtgatcgaaaaagagaccgttcaagaaacgattcatggaaattggctgattttagataatgtccaggatccagggaatgttgggactatgattcgtacagccgatgctgcgggttttgctggggtctttttaggaacaggcacagctgatcgttacagcacaaaagtcttgcgtagtatgcaaggcagcaactttcatttaccgatccttgaaggggatgtgccagcattcatccaaaaattaaaagcccaagggactgctatttacgggactgaattgaataaagaggcggtttcttatacggagttatctaagaaaggaacagctgcgtttatcttagggaacgaaggacaaggcgtccatccagatattttagggttgaccgatcaaaatgtctatattcctatctatgggcaagcagaatcactgaatgtagctattgctgccggtattttgatgtacttttttgtcagttagacttttttaaggaactgttaaactcaaagcaactctttggattctcctagaattctgtctgagcagatgctatacttctatttgtaagaaataagcagtatcaaaaaggtggcaggcataaatctatgacagaaaaatggcaagaagatagcgagtatatgtcttatgtagcagatttgttagagacagaagctgtaaaaaaattagccaattatgttcaacatatgagttccacacgtttagaacattcgatcagcgtttcttattacagttataaattggcaaaaaaatggggcggcaatgctcgtgcaacagctcgggctggattattgcatgaccttttctattatgattggcgtacaaccaaattcgatgaaggaacacatgcctatatgcatccgcgaattgccgttaaaaacgcagagaaaattactgaattaagtgatctcgagcgggacattattttgaaacatatgtggggagcaaccattgcaccaccccgatataaagaaagttatatcgtaaccatggtggataaatattgtgcggtgaaggaagcatcagaaccaatgactcaagccatgaaagcaaaatggcaacaacggttttggcataaacaacgaccaacacatctctaataaaacaggcaagcgcctagaatctgtagtgatttatcagattccaggcgctttttttgtatggtggtgaaacaattggatcgtggtgctcatgattccattcaaagggcatacttacgctagtttccaaagaaaaattcgagaatagtcatcaaaaagatgatgattgcaattccgcctatagctaacgcatgtctttttttgtgcatgaacaaaatggcgatatattctcgtaaaaaagcattcggcaagtaatagaaggctgtgtgtgagccaatcccatctgctttgacatgcgcttggtcggcgtacatccctgcccggaaaatatgatagttattggaagcaaagattgcgtgatatccttctggacgtaacgaatccatgatttctttggagaatttcatattttcgtaagtcgttgtcgaattggcttccactaagatttcactttcagggattccttgagaaacggcatattctttcatggccactgcttcaggaattttttcgtcgctgccttgaccaccggacatcaaaagacgaggggctgttttcttcgcacgaaattgaagatgataaaatgcgatagctttatcgatccgttgggctaataatggagaaactttctcgccattaaggagacctgcccctaaaactataatgaagtcctggtcatagcggggatgattgaattgataaataaccgagatcgacaaaaagttaagaaaaaccacaaaaaaataaagcagcgatgccggaaaaattgtaaataaaacactgacccaacttggtaaggcatgtaaaaaggaatccgataccaacaagatcgttaaaacgatagctaaaaccaatgtcaacaggttggccaatgagtgggattctcggcgtaaaacgacgattgaattccaatagaggaaaataatcaatccatacaaaccaaaaagaaaaacgaatagaaagccaactaatgcaacagctaaaatcccgccgactaaaatatcttctgtccgataaagattaacgagcaaataaatcccaaaggtcaagatgaagacattaaaaagcaaaccattcactaaacgatgcttgtttttaaaataggaatataaaaataatccggccaaactaagcggggctaagataaaaaaactgccagtacgtaattccgaaatggacaaataggccaataaagcggcaatcgtccaacaacactcgaagaaaaagatatctgggtcatcttttttcttgcggtaccaaaaaacaaaaatcgctcctaagatataagcgatactgaaaagcccaatttgtgtaaaatccattcttttcactcctttaaatctaagaacagtatacctaattttcgaagaaaaagcttgcagatgtggtcaaagttgctgaattttcttgaattcgctacaatggatagagaagaaagaaggaggcacaagcatggaattaggtgaagtgatccgagtaacactcccagcgttttatgttgtcggaaaagaagggaaaggtcttgctgaagaaggcccttcatgggtaccggcactatgggatcttgcaacgaaagattttgaagaaatcgagtttttgctagccgatcaagaagcggaaaatctgcagttctggggattgatgagtgacggagagaactggctggaaccatggcaagagacaggacgttaccttgcgggtgtccaagtcactacggataattttccaccagtagattgggtccgttggcaaatgccagagatggaatacatggtcgtaaaaacaaatgaagccaatctaaacatgatgacagagaagatgctgagagaagttcttccagaaaataatgttcaactggcagcagctattcaggaacactacctgcctaattttcaagaaggggaagtagaactgtattttcctattgaaccgattgcgcctgttgtaaccaaagaagagttactctcttaacaaaaaacttccagtgttttagtgattaccggtcttaccggcaacgccaaacactggaagtttatttttgattaaaagagatttgtaaagaaattggcaactgatcgccagccgataacaaaaatatttgctttttcaacggctttagtagtgatcagctcagtagtagggacttctttactaccatccatataacctaatgtatctgcaggaatcgttgctgttacttttcctaaatccgttcctttggcaactggtgcagagacagtttcttcgttcattgttttgttataatcgattgttgtagtgaagtcttttggatccatatctttacgtacccaaacagaaagatcattttttaccgctatgggaacagtaagttctttgccgtttttaacagcgaccgtttttgtatctgctaactgatcaccagcagatagaataggaacttgctcccacgcatcaaatgagtaatccatcagtttgcctgtttcggtgaaacgtacactaggattctcagcatgaccgttgacgtttaacactacggtgataatacgctggccatctcgcacagccgttccaacaaagcaagcacctgctaaatcagtggttccggttttcaaaccgtcaacaccatctttggcgttgatgaaaccaggtagcatccagttccagttgaccatctcaactggtgagtaggaaccttcaccaaatgttttggtaaccgtgctggtgacttctaatacttctgggaagtcttggagcaaatgtctcgctacgatagcgacatcttttgcagataattcattttcatcagtggaagtggaaccagggtaaaggttttctcccagataggtgttattcagtccggaagcattgacaatcttagcatctgtgattccccattcagtgagtttgtctttcatttgatcgacaaaggctggctccgacccggcaattttctctgctagggcaacgaccgcagcattagctgattgaatgtagctcgcttcataaaggtctttaacggtgtattgaacatcacgatgcaaaggaacattggacaagtcaggtgtgacactgaggtcggctgcatattgtgagatttcaacagggtcttcccaagtcaatttgccttgcttgacttgttctgctactagatacagactaatgatttttgtcactgaggcgatgcccatcggggtttctccctcttggtcatataaaattttgcctgtatcgaaatccactgaaaaagcagcttttgcatcgatagaaaagtttttgatttcttcagcggtaaatgtagtctcctcagcgtgggagatcattggtattccggcaataaaaaagagggttgctagacccgcaatcaatgaataccagattttggataatttctgcataggtaaactccttcgtttctgtatctaaatcaaaagtttaacaaagagtttcctgagttgcaatactctaacagaaagttcaaaaattcgtaagaaccagcttttttcttcttgccgaatcacaccagtgatcgctttgtcttgaaacaacagttgtttttagacataaaaaaagcttttctttaacgaacaaagaaaagcagtttttttatctaataaaactatcggcgaatatgatttcggggatcctcactttgcacttttacaggtactttcactgctcttgtttcttgctgcatcaattggcgggcaagaaacagcgttcctccaagtaatgcggctaaaccaaagattgaaaaaagtgaaacaaacgtcgctaacatagaaatcccttctttctgtttttaattaatgtggaaggtaggaatcgaacctacaccttaatctatgaacgatcatctatcactcaacggaacaccttgttcaaccacttcttattactatcatagcatgaactgtctaaaaatgctggtagaaagtctgagcattttcagaggaaatcaagaataaataatgaagaaactttgaagaaatcattcgatttttgtcaaaggatattgccaatcttctgcttcatcataaagggtgaagcgctggtccttttgttcaatgatcaaatggtaacccaatgaatctagtaaaaccaatcttgatggggtcagctcaacgatcacagtaggtgaatgtttcccatcaattgtcagtgaatgctcctctgtgatctcaatggatacagtgtctttcatttttgaagtgaactgccatttccccacgaattgttggcggggctcagttttttgcttttcttttcttaatatgagcgaactggcaacaccggtcaaaagtgacagaccaatcaacagtgaacgttttttcacattttcacatccattcctacctatgatggaactagtataccatggggaacaaagaaatcctcctactttggtcggaactttaaaagtttttaattgaccgtataatccatttatcaaaatcttacagccctcagaaaataccagaaaattgcagcggcagcggatagctgcagcaatgatgctgacccaaagcattgttccatagcttatggtaaaatcagatagaaagttttctgctttctcctactttaattgaaagagagtctttcactgagaatcagaacatcatcaattactagatcaactgatttagcgtttatttaaggaactccggctgttttaaggccgaggtattaatggagagggaaaaagatggaatatccaaatagtcacttagcgatatttattattcgggaaaatcgctttattgcccgctgtcgattgatgtcaggggaggaagtaatcgttcacgtcaaaaatactggtcgaggaaaagaggtacttgttgctggtgcgttagtcactttgcaatactggaatagtccaaagagaaaaactaattatgatttgatcgcagtaaaaaagggcgaccaatggatcaatatcgacagtcaagtcccaaaccgtttggcctatgaatccttattggacggaacgattcttttaccgcagatcacaggcaatctaactttactaaagagagaagtgacgtatcaccgttcaaagtttgatttttattttgaaacagatgtcggagaaaagggctttatagaaatcaaagggatgactttggaaaacaaacgagtgggtgcttttccagatgcgcccaccagtcgcggattgaaacatgtaagtgaactgatagatgccaagaaagaagggtactatgccgcggtattgtttgtcgtccaatttgaagacattgatgtcgcgacgatccatcgtgccatgcaaccagagctagcaaaaaaaatcggacaagcaattgcagacggaatccaagttttcgcgtataattgtcttgtggatgaaaccagcatttccattaataaagcagtaccttttgatcttatggctgcttttgaagacccaaacttataaggaaagagggaatatgaatgattcatttagggataatcggtacaaattggatcacggatcaatttgtacaagctgcacatgaaacgggacgctaccatctaacggctgtctattctagaaaactggcgactgctcagtcttttgcagagaaatacggagaagtgacttgtgtagatgatttaacggctttctttcaactagaagaattagatacggtatatattgcatctcccaacaatttgcattttgaacaagcaaaacaaggaattttgtcaggaaaaaatgtgatcgtcgaaaaacctgccttttcgacaccatcagaaatggctgagatcattgaattggccaatgaaaatcaagttttattttttgaagcagcgcgcaacattcatgagaaaagttttgacaccattgcgtctgtcttaactgaacatggcaatatcattggtgcaaactttacctatatgaaatactcttcacggtatgatgcagtgttagcaggagaggagccaaatattttttctccccatttttctggcggcgcattggtagatctgggtgtttatcccgtttatgcagcactagcttggtttggcagaccacaaaatgtttattattttgcccggaaaatcgtgacaggagtcgatgggatcggtacgatcattttacgttatgaaacttttgacgtaaccattcaaactggaaaaatcggcaactctgacttgaaatccgaaatatattttgaaaatggaacactggaactaaatgcagtcaatgccattgaacaagcggtattttatgaccgtacaaataatgaaacggtattaccggtgaccgcgcaggcaaatccgatggtcgaagaagctgcagattttgcagaagtcatcgaaaataaagcagatccccaattgggtgcgcgctatgaagaatggatcgaattagctcgtgatgtcaatgaagcgatctatctcatgagaaaacacgcagaaatctcctttgacgcagacaaagagtaaggaatggaatgtatgacagcaacttatttagcagaagtttggcaagaaaaatggcaaagcagcggcttttctgcgccatcactgattcaagaacgggtttaccccctcttgaaatcaggacaatcagtagtaggcgtttcgccgacaggttcagggaaaacattggcctatttactacctttattggaaactgtaaaagttggtgaaggcaatcagctcctgattttgacctcttcccaagaactggccatgcaggtcacacaggtcgcacgagattgggcccagcttttagatttgcaggttttaccactgattggcggcgcaaatactaagcgacaaattgaaaagttgaaggccaaaccagaagttttggtggggacaccaggacgagtattggaattgctcaaattaaaaaaagtcaaaacgcaacagattcacggggtagtcttggatgaagtggatcaattactgaaagaaggggcctttgggctcgctagcaaaatcttgacgcttattccaaaacaggcgactcgcagtttcttctctgcaactgccaatgaggttctaaaagaaattcaagaactggcttttgaaacaccacaggtcattgatgtgacagaggaagaccagagcaaaggggtgatccatcattattatttgaattacccgagtcgtaaactagtggatgctttgcgccggttggcttacttaccagattttcagggattgatttttttcaatgaattaagtgcattaggtaatgctgaagaaaaactgctctttcatggtttgccagtcgcctcccttgcttcagaccagaacaaactgacccgccgtgcttcgcttgatgggttccgtcagggaaagatttgtgaattactaacgacagatgttgctgccagaggattggatgtcgatcagctggggtatgtggtcaataccgaggttccacaagagaaagaatcttatcttcaccgagcaggtcgtgtgggacggatgggaaatgagggcacagtgatcacgatcgttcaagaccatacattaaaggatctaaagaaaattgccgcacagctggatctaacgctgcaagaagttttcttgcatggaggtgcgcttcacacagagcgtccggaagttaaaagtgaacctaaaaaagagcagagtgtgcagaaaaattccagaaaaacttctgaaaaattacacactatgccaaagaaaacgaagaaaaagcaaaaaaaccaaaaagataaaggcaaaagacgccattgagcgtctttttgtgttaccattaacggtggttaattactagtgtgtaatattgaggaggcattttcgtgaattcaaggaaagaagaaatctttcagacgatcgaactgcacaaacaaggtctgacagccttagaggttgcggagattttacaaatcgatcgcagtaatgcaagccgttatctcagtgaattatttaaagaaaataaaatcagcaagcgtgctggtcggccagtaatctatgaaccattgaatgaggaagttcatgtggatgtgtcctccgaggttagttttgaaagtctggtgggcgttcaagcttctttgaaagtcagtatccaacaggcgaaagcggccattctatatccgccccgtggactgcatactattatattcggcgaaaccgggaccgggaaatcattatttgcggagtgtatgtatcatttcgctgtggaatcaaaaatgctgaaaaaagatgccccatttgttgcgtttaattgtgcggactatgcgcaaaatccccaattgctatttggtcatatctttgggatccgcaaaggagcatacactggcgctgcggaagatagtcccggactaatggcgaaagccgatggcggtattttgtttctggatgagattcatcgtttgccgccggaaggccaggaaatgctctttacctttatcgacaagggagtctatcgtcctctaggtgaaagcaatcaagtgtacgaagcttctgtgcagatcatcggtgctacaacagaatcttcagaaacatttttgacgacattcaaccgaaggattccaatggccatcactttgccgaatgtggagagtcgttcactggatgaacgatatgaaatcatctccttatttatcaagcaagaagcaactcggctcaatcaacggatcgacgttgagcgagatgcgattttggcctttatgctgtatgaagcagaaggcaatatcggtcaaatcaaacgtgatttgaaattagtctgtgccaaagcatttctccattatcggacctacggcaaaaagcatttattgattcgtaaagaagattgttcactgcaagtccaaaaaggattgttgaaaatcaaagaaatgtcggaacgtctcgatcgatttttagaaggcaaaggcgattttttgagtttcgagcctggggatcaagatgttgtttggtcacaagatcctcaaagaaatatgcaggtttacaatgagattgaagagaaagtcagcagcttgatcgagacaggtgttgcaacgatcgatctggaaaatctgatttccaaggatgtggatgcctattttgaaatgtatgtagaagagctgacgcaaaatcccgttcacaaagagttgattccagaagatatttggaaactgaccaatcacctttatgatatcgctgagcaaaaattggatcgtacatacaatgaaaaagcacgttttgcctttgcacttcatcttcaaagtacattagaacgcgtaaaagaaggccacatgatcgttcatccagacttaaatacgattcggaaaaatctgaaatcagagtttcaggtggcgatggatctatcaactattattgaagaggaacgacacgtggagattcccttcgatgaaattggctttattagtatgtttctagctattcaggtgaaaaaacagatcatgccgcttgagaaggtagaagtcgtcgtcttgatgcatggaagagcaacagctagcagcatgctggaaaccgcacaggagctattggaaaccactagcggttatgcaatgaatatgtcattggatacagaagtgggcgccatgtatgaaaagttactggcctatgtttctaagaataaagataaattaagcaatggtctattgcttctcactgatatgggatcattgaactcttttgcaacacttatttatgaagaaacgggcattcggacgaaagcaatctccatgtccagtacgatgatcgtgctggaagctttgcgcatggcagagagtggacgcagtctcgaggatatctatcaaaacatccagcgttcctttgagacgatcgttcaagagcaattccgcacggttcgggaagccaaaggcaataaaaaggcagtaatcgttacgtgctttacgggagaaggtgtcgctgccaagctgtatcagcgcatctatccggtcgtcgatcaagagaaggtcgaaattattcaaatgcaatttattgagaaagaaaccttcaagaaacacatcgatgggttgctagaagaatatgagatcaaagccatcgctggcacagtagatatcgattatcaaaacattcctttcttttcggcttatgatgtctttgatgacgaacggttgaatgtgctgaagcgaatcgtttctgatgaagttcccatcgagaaaattgttcgctctcttgaaaatacccttacgcatgtcgggtctgtctaccatttgatcgagagcttgcaacgaatcgtccatcaggttcagaatcagctgcatgtgacactagaaccgactgtagatgccgggttagtaatccaccttgcttttcttgtggagagcaatttgaagaaggaaccttcccgagcatttaaggatttagcaagcttccaaaagcggtatcgaatcgagaccgatgtgttgcgaacgaacttgctgcaaatcgaaaaaaattatcaaatcaagatctctgaagatgagattgcgtatctcacacagatgttcttagaaaatgaaataaaaaatcatcatgaatccgcacacaatattagtgtgtaatgagaaaaagtaaaagtgtgtaagcgttaaattggtgcagaccattgttaaatcaaggtttgcactttttttattttggcacgctttttgctttatagtaaagtgtaaataataatttagaaaggagtgacaatgatggcgaaaaaaacgattatgctcgtatgttctgctggcatgagtactagtttgttggtaacaaaaatgcaaaaagcagctgaagcaaaaggaatggacgcagatatttttgcagtttccgcttcagaagcagaccaacatttagaatcaaaaccggtggatgttctattgttaggcccacaagtacgttttatgaaatcacagtttgaacaaaaattagcacctaaagggattcctttagaagtcatcaacatggctgattatggcatgatgaatggcgaaaaagttttagcacaagcagaaagcttaatgaagtagtgaagtaagaggaggatttttttgatggacgagcaaaatttggaagccattatgggtttgatcatgtatggcggaaatgcgaaaagtgatgcaatggaggcaattgcggcagccaaagaaggaaattttgaattggcagaccaaaagattgcggatgctgaagcatctttagtagaagcacaccactcacaaactggtttgttgacacaagaagcacaaggcaaccatatgacagtgaccttgttgacggttcattcgcaagaccatctaatgacatcaatcgcatttacagatctagcgaaagaaatcattgatatttatcgacgtatgagtaacgaataatctttgaacggatagaagtagttatttgttgattttatctcttagaaaaatcttctttggcgaatagaacttataggaggacataaaaatggatggattaacgagttggatggagaaatacattctccccgtagcagcgaagatcggtgctcaaaagcacttagtagcgttgcgtgatgcgtttattggaacaatgcccgcgacaatggctggttcgatcgctgtaatgatcaatgcgatcattcgcgatctgccgccacagttttggcctagttatgatgcaagtacaattccagttatacgtgaaattattagtattaatgggtttgtttggaatggtacactagctgtagctggattggtttttgctttttcttgggggtataacttagcccgagcataccgcgtcaatgaccttgccggtgggatcgtcggaatggcgacactgatccaaggaatcgctttttcatatagcacatctgttgcgacgacagttcctgcaaatttgatggatgaaatcaatgctggtacagcaacaactggttggtcagcaacagctgaaggaattacagctggcggctggggctggttgaatttgaaccatctaaatgggaatgcatactttactgtaatgatcatgggagcaatctcagtcatcattttctgtaaattaatgttagccaatattacaatcaaaatgccggattccgttccaccagcagtttcgaaagcttttgccgcaatcttaccggcaacgatcgctttgtatgttattgctattattaactttattgttggacaattgacggatggacaattgattatcgaccttgttcagaaatatattgctgaaccattcttgggtctttctcaaggaataggtgcagtcttgatcgttactgtttttgtgcaaatcttctggttctttggtatccatggtccaaacgtattggcaccagttttggaaggtatctggggacaagcacagttgatcaatattgatattttccaaaaaggatatgatggaaaaactggaacaagcgcggtattagcagccattgaagatggaaaagcgtatatgtgggttcgtggatcattcgatgcatttgcatggtttggtggttcaggtggaacgatcgttcttttgatcgccatcttagttttctctaaacgtgcagactatctgacagttgccaaattatcaattggacctggtatcttcaatatcaacgaaccagtcatgtttggtttgccaatcgtattgaatgcgatcatgttcattccattcattattgcaccgcttgttgctacaacaattggttggttagctacttactggggattagtctcaccagtttctcaacaagtaacttgggttgtgccgccaatgttattatcattcttagcaaccggtgcagactggcgtgcgccaatcgtcactttagtatgtatggtggtcaccttcttcatctgggcaccatttgttatctcagcaaataaaattgatccaaaattaggcgaatagccctttaatcgagaggaactgctatcgcttcatagttgaggtagcagttcttcttttcattcatttagaatacagttagaaaacagcagcaagaaaactgctcaaggaggaataaaaaatgatctcaatcgcaagtgctatgcaacaagatgcaatcaaagaattattagaaggatacaatgaagacggtgtgtcttacacatttaaagaaaaacaagggatcaaattgatttttactaccacagctgacgatgcagaagcagcagctaaaaaagcgaaagaattgattaaggcccaaccatggggatctgtgctatactttcaagcaaccgctgtttgatgtcgtaatacaactgatgtcagggacgattaaatagatagggatgaatcaaaatgataaaaaacggcttatttttgtgcagtatcgggttgcttgtgattttgtatagcatgaacccaagcaatatgcgtttagacattttcagttttactactggaattgctttgctgataggcggcggtttgttgtttatgaaaggcaagaaaaaagctgatcaatcaaatggaggacagtctaaatgaaaattgaaaaaacattgaacgttccaagtccagtctttttcgataaaataatcgactcagtgatatttgatatccgcaaggcaacaggcaaaacggtttcccgcaaacagttagccggatatgagtacgtcaaggaattttcagcttccagccgtgcaaaaatcaaaattgaagaagtcattgagaatcaagtctatcagtttcggacagagacaaccaaaaatgagtttgtcgttcgctatgagctggaaacgataaatgaaaagcagacaaaggtaatttatacggaaacgatgaagtcattcggtattttgcaacaaatgaatgatatgctgcttggaacgattctaggttattttaaacgaaaacaattcaaaaaaatgctggttatgatggaagaatcatattaaaggggtcctgtgacgccttttttgtgttttccaggtaggtaataggaggaaatcggatgagtgatgtacgtagaatggatgaagcaggcccacaagaagttttggatttagtggcttatgctttccaatgggaattaagtgtgaaaaataaggagcgttatcgcttactagcagagaattcatggaactatggttcgtatgatgatcaaggaaagttggctagtcaaatcatggccacaccttttgccattgattttcatggaacaagctatccgatggcaggaatcggttttgttgcgtcatatccagaatatcgaagtcagggaagaatcgaccgcatcatgcgccacatcttggaagattgttatgagcagggaattgtcctttcctatttagcacctttttcttttcccttttatcgtcgctatgggtatgaatacgtctttgaacgtatggtctatgacgttgctgctcatgaatgggccgatagtcccaaagtaacaggttcgattcagcgtctgccatggtcagaggctaaaagtgtgatccacgatatttatcatgcgatgccaagacataaaaaaggcggattgctgcgagcagattggtgggaaacgatcaaatttacgtatcgtaagccgtatacatttgccatttaccgcgatgaagctgggaataataccggttatttagtttatacgattcaagaaggcaaattcatcattgaagagtggggatacttaaatattgaggcttatcacggattgaatcgattgattgtctctcatgcccgttctgttgcccgaatcatttatcaaccaggttatgacaatgatattcgccaggcaattgctgccaaaccaatagcacactatcaggtgagaccggatatgatggcgcgggtagtcgatgttcatcgctttttggcgcaatatccttttacttatcagctaaatggagcttttgctattgagatccaagaagataaatatgcgccttggaacaatgggatttatgaaatctctatcaaggacggtcagcattcagtcgaaaaagtaacgcagacgcaacaaccaatagtaaaaacaaccgtgcagcgttttgtccagttatttatgggataccaaacagttgatacaatggttttcttggaacaattagtggtaaatgatgcagcaataaactgcatcaagtctaatcttccaataggaaaaccaatattagaagactatttctgatttatcgagtcgtccaaccagcaaaatacctgatggttccctcgcgttttaggtaggaatcctttaagaaatgagagcagtgatacggacagctgatggaccagatctgttttatcatctttggttttaacttgcttcttagacaagtgttctgttgcagctaagagttttttatctgataagcaaaaaactcttgtccaacaagagtttaacaggttctttcaacgttccctgccggaatcgaaccagcaactaatccttaggagggacttgttatatccatttaactaagggaacacaacaatcccattttacctgtaaattcatcttcctgcaaccctaagtcatagttatttttgttgcgggataagggaagatgaggaatagaaacccgatttatgcaatcgttttgctttatggataaaaataggcatggtacactttaggtgtaaccgatcaagtaggaggtaatgttgaatggtaaaatttgggaaagcttttttgtcgcaattaacaactgacggaatcaatggaccatttgtcacgatcatgctaaatactcacgtaggtcaccaaaatgtagagaaagatcaaatcaaattcaaaaattttgctaaagaagcaaaacgccgatttgagaagagatatcccgaccactcatggaacaaattccaggaaaaaattgagactctgcttgctgatcaggcattttggcgcagcagcaccaaaagtgtggcagtgatcttaacagcagaagaaacattgatccatcgcttgagtattcccgtggatgatcaatactatgtcggagatacaccttatctgttggcgatcatcaaaaatgcccaattcaattatgccttttatttacttgcattgaatcgggattccatgaaagtataccatgttgaaaacaagcaagtcactgaagtggcattgcctgaagacgctcctgttgacattgagactgctcttggtgaagaaatcagcggtggtggagatttcaattacagtgcacaaggtgcaccaaacagttctggtgaaggcgttgcctaccacggcttcagtgctaaagacgaagaggttgagatcgatcatgtcaattactaccaagctgtagacaattattttaaaaatgaatttccaaatgaggaaaatttaccgctttatctttttgcactccctgaaaatcaaacattatttaagaagattgcaaaaacaagtttcttcaaaaaagatgcttgtattgcgtcatcgcctgcttcattatccccacaacaaattgctgagtgtgcgcaaaaattgatggacgatctgatgcagaatgaagtagcttcttacaacaaactgcttgaccgcaaatttatggatcaattagtggacattgtaccagcagcgaaagaaggacggatcgcgcagctctttatcgccacttcaaatttagtggatggcttcggagaagacccggatactgagtatgatcgtcggcaagtgctgaatacattggccaaaaatgtgttggaaaacagtggagaagtctctatattggagcaaaaagatgcgccggatgagaaaagtttaactgcgatcttgcggtactagtttcctaaatatccgtaaagcaccagttgaataaattagcctgtgacataaacaacaagaagaataatctgaacgatttaccaggattgcttatcccttgtatagttgctactagaacttacaaactgtaggagcaatcgtagaatttttcggattagtccctttgttgtagaacatatgtcacaggctttttctctaaaaaagtgccttctttgtggggaagttaagaaataattgcgttttcattttttttaagtttgcgatagtcaagaagcaaaaactgtgctataatacgaagtgtagtttttgttacggtaatttatggtagcttgtttcattttaaaacatctcccacattttcaccatatacaagtaattgcaaaatatgtgttttaacacaaggaggatttttattatggaaacaggtacagtaaaatggtttaactcagacaaaggttttggtttcatcactgcagaaaacggaaacgacgtattcgttcacttttcagctatccaaggtgaaggcttcaaaactttagaagaaggtcaagctgttactttcgatatcgaagacggacaacgtggaccacaagctactaacgtaaacaaagcttaattattgcctatcagagcagcctagctgctctttttttgtgctttcattcaaaagaaggtagagtctaaatttgtttgcattttctgtatttgttatacttgaaaaaagggggactcaggatgggactgaatgaatttattttgggactggcgaatttggaaaagattcaacgggcgccggggttctttaagtttacagaacatagcgtcgcggcgcattcttttcgagtcgcaatgattgcccagacattggctgatattgaagagcaggcgggaaatacgatcgattggcagattctctatgaaaaagcattaaatcatgattatactgaacgattcattggagacatcaaaacgcctgtcaaatatgcaaataaagaattgcggcaaatgctttcgacagtagaagaaaagatgacagatacattcatcgaagaagagattccagaatcatttcagccgatttatcgtcgtagattagcggatggtaaagatgattccctggaaggccaattgttggcgatcgcagataaaattgatttgctttatgaatcttttgaagaaatttcaaaaagcaatccagataaagtctacaaagaaatgtttcgcgaagcagtaatgacggtcaaaaattttaatcaccgtcctagtgtgtcttacttctttgaagcggtctttccagaactattgaatgcagatttctatggaaaagaaaattttctagaagaaatcgcaaacctaatcaaaaattgaaatggtctgtgaaacaagtttacctatggaaaaaacatactaagagcagaggagaaactcatccgtcgataagttcctcctctgctcttagtatgttgtatgtttttgaagccttgtttcacaggctttttttattacaacaatgattctgctccatcaacatagacttctgtacccgaaatgtttcctgcatcttcagaggaaagaaacagcacgaggttagctacttgttctggaataccagtctcctgacgcaaaggacgttcccgttccggaaagacgattgggattttgattttttcaacagcctcttcgatagccgtattctcatcaatatttgttgaaatcgctcctggacaaatcgcattgactcggatgttgtagccggaaagctcgagtgccgccattttcatgaaagcaacttgaccagccttagatgtgctgtaggcactagcgccgaaatttttgaaaattcggttgccgttaaccgaacttgtgatcacgatactgccgccgttgatttttaaaaaaggaattgctgctttaactgtgacaaaagtactgcgaagattcgttgtaatggtcgtatcccaatcatctagtgaaagctcttcgataggggtccaggttccattgatccctgcattaacgtggagaatatcgacaccacccaactcttgtgccaacgctgtgactgcctgtaagagctcttctccttttgatacatcaaccacacgataaatcgattgaccttcagtagcttctacaaatgccttcaattctgtttcatcaatgtctaatagaccaacgactgctccttgatccagaaattgctgggcaactgctttgccaatgccggatgctgcacccgtcacgataacccttttattttcaaaccgtttcatttaaacgcctccttcttaattaaattataaaaaagttcctgacctttgtcgaaagatacggatggtccattgatttttgataggatgaacgtatgaggactttagtcctaaaatcaagcttctcgtctgattgatctcaaaatttgatttcctcgttattggctaaaacagatgtaagaggcaaagattttgtagtataatgcaagaagtgcgtaaggaggaagcgaaatgaaacccatatacgctgtggtcgaccttgaaacaacggggactgatcctgccattgatcgaatcatccaatttggctgtgttttgatccaagatggtcaggtcattaatcgatttgcgacagatatcaatccggatcgaagaatatcaaagcagatccagaatttgactcatatcaccaatcaacaagtgaaacgagcaccgtatttcgaagatgttgctcatacgatttataatttgttaacacaaacagtctttgtggctcataatatttattttgactatcatttcttaagtcaagaattaatccgatgcgggatgccgccccttgagattccaggaatcgataccgtggaattggcgcaagtttttttgccgacagaaagcagctttcgtttgggagatctggctgaaagtatcggatttgttcatgagaatccacatcaggcggatagcgatgcggaagtgaccgcggcattattgctgtacatcgaatcgatcatgcgtgaactgccatgggtgactttaaagcaaatcgcccagttgagcggtcaaatggggatgcagaccagtcagtatattcagcggatcgtcagtgaacgtaccgaagagccgcttcctgaacatttggaagaaatcgatggattggttctgcgaaaaaagagtgtgccattgtttgaatcaagctattttcaaggagagtatcctaaagttaaagcggataagatcaaatgttttgatggtcgcctcagttatcgaaaacaacaagcgcggttgatgaatgctgtttatgatcacttttctcatgaagaaaaaaatctgatcattgaggcagaaaccggcatgggaaaaaccatcgggtacttatttcctgcaagctacttagctactccaaaaaacccattaatcgtcagtaccacgtcgattttgctacagaatcagatattggctaaagacatcccattagtcaatcaagtactggaacaaccgttgcaggcaactgttgtgaaaagccatcaacactacattgatctccagcggttcaaagcaacattagaacaaccgcttgaacaaaaacagtatgcccagtaccagatgggacttttagtttggctgaccaaaactgagaccggagattttgatgaattgaatcttgtgcgtcttgatcatccgttgtttttggaaatccgtcatcgaggggtggattttttggcaaagaatcaatctttttatgagcaggattttgtgcgccatctctataataagatgacacaaagcaatgtgctgattgtcaaccatgcatttttgatgcaggaaaatcggcgacagtatccactactaccaacgagtgactttctgctgatcgatgaagtccagcatttgccggagattgccgaaagatattcgcaaaattcctttgattcccaacagttcaaacgacaatttttgcaaatgaatgaagaaggtttgtttgaagagatcaagcaactcgtcgctgaagaattcgatctttcccatttattttcattgtatatcgatgccatcaaattgattatcgatacgctagaagcctattttgaaacactcgtgatcgatggggaagaactgacacttgtccaacgcaaggatctttacgatggcagcttgcagcaagatcgtctccatcaaaaaattcatttgtattataaagaaattttagaaatccaacagcgattgcagacaaccttcatggcgacagaagaacggcgattggctcgggagcgcatcctgattgcccgcttgttcgattatttccatgatatggaggtacaggcagcgacggttcaatcgtggctgatgaattggcaacctcggtatgtccattggatcaagaaaaaagcagggactgctgcagcgatgattgaagtggcagacctgaagggaaatcaaattatcgaaagcaaatggtattcaaggtacaaacatattctttatttaggcggtacattgaaaattcctggtaacaaatcttactttgctcaccgattaggcattcctgaagtgacggtcaaaacgattccggcattttatgattatgaaaagcaagcacgcctgtttattgtcaaacaaggaatctcaattcagcaagcaacgaatgaagaatacgcgcaatatttggccgatgcattaacaccgttgctatttgaaaatttgcagccaacacttgtattattcactgctcatgaaacattgaaacgggtctatgaaaaactgcataaaaaagccttggaacaaggacgagaacttgtagcacaagggactggcggtagtcgcgagaaaatcatcaagcgctttttactggcggaaaatgggattctttttggaacagatagtttttgggaaggcatcgatttacccggtcaagcgctcaaaatcgcggttgtgacgcgcttaccatttgagaaccctaaacgaccgcttgttcaagcacgtcatgcttttttagcatcggaaggcattgatcctttcaaggaggatgcattgccaaaagcaattatccgaatgcgtcaggcgttgggacgtctgattcggtcggaaaatgatcaaggagtaatggtggttcttgatcgtcggattctttctacgaagtatggcaagcgaatacttaaaggtttgccaaaaaatctgccggtcaaagaagctacaccacaagaaatgaccgaggacatacgggcgttttttgattctggagcagaagaaacaccaaaaaaacatttttcttaaaagatagctgaaatctgctataatagagcatattatttttatggaggataacgagtgaaaacgaaagacaaagaacaacgccgtgtgatgattttactgggtgcgatcgtttttttattgatcgttatcatattctcatcaattttctacatccgttcgactcgtccgatgcgacaggcacgcaatgaagcaatcgaaattgctcaaaagtatacggatttgaaagaggtcgatcaattttattggtttaatcgtcaagcctcttcttttagtttagttggtacagatgataaagaaaataaaatcgtcgtcattattcctaaaagcggtgaaaaagtgtcagtttttaaacaatcagatggtctaacggaagaagccgctcgtcaattggttgccgaaaagcatccagaagaaacgatccagaaagctactttaggattgtttaaagagcaagctgcttgggaaatcatgacgaaagatgcttctggtgaacttcattattatttgctaggttttaaagacggcaaggaaatcaatgccatcaataatatttgatttagagaaaggatggttgacatgacactctccaaacgagcgtatcaagtagagccctcagttacattagctgcagctgccaaggctaaggcgttaaaagcgcaaggcgttgacgtattgagtttgacggtaggagaacccgactttattactcctgagaatattcgtcaagccgctatccaagccattgaaaatgggaaggcaagtttttataccccgacagctgggatccctgagctaaaagaagccatcctacgctatctgcaggagttttatggcgtaacgtatgacaccaaccaagtgatcgtaacagatggcgctaaatttgcgctttatgcgttgtttcaagcagtgatcgatccagcagatgaggtgattattcctgtgccatattgggtcagctatgcagagcaagtgaaactagcaggagggcaaccagtcttcgtctatgctgcggaaaccgagcaatttaaagtaacggtttctcaactagaagctgttagaacagccaagactaaagccattattttgaattcgccttccaatccaacgggagcaatttattcgaaagaagaactacaggctattggagagtgggcagttgtacatcatatcttgattgtttctgatgatatctatggtcgtctgatttacaatgggcactcctttacgccgattgctagcttgtctgaggctattcgtaagcaaacgatcatcattaatggtgtctcaaaaacatatgccatgactggttggcggattggatttgcagttggcgatcagacaatcattcaagcgatgacggatattgcttctcaagcaactagcaatcctacagctgtcagtcaatatgctgctgttgaagcactgtcagggaatcaagactccattgaaatcatgcgtcagcaattcgaagaccgattaaataaaatctatccgattgttgcagccattccaggttttcaattagtaaaaccgcaaggcgctttttaccttttcccaaacgtcagggaagcaatgaatatgtgcggatatgaagacatcaataattttgtggaagcaattctggaagagaccggagtagcagtcgttactggtgctgggtttggtgcaccagacaatttacggatcagctatgcaaccgattgggcaaccttggaagaagccgcaaaacgtttgcaggattttgttgaaaagaaaagccgaaaagcttaaaatgctttatggaacccttattatcagattggagagaaacgtgtggaatctattcaaattttagatgcaaaaaaacatgttggcgaaacagtacagattggtgcttgggtcgcaaacaaacgatcaagtggaaaaattgcctttctgcaattacgtgacggtaccgcatattttcaaggtatcgtggtaaaaaccgaagtgggcgaagaagtctttcagcttgccaaaaatttaaatcaagaaacggcagttctagtaactggtgagattcgtgaagatagccgttcgaaatttggctacgaaatcggcatcagcggcattgaagtagtgggcgaaagccatgaatacccaatcacaccgaaagagcacggcaccgacttcttgatggatcatcgccatttatggctacgttcttcaaaacaacatgccatcatgcagatccgtaacgaagtgattcgtgctacctatgaatttttcaataataatggctttatcaaaattgatccaccaattttgacagggtctgcaccggaaggaacaacggatctttttgaaaccaactattttgatcaaaaagcatatctatctcaatctggtcaattatatatggaagctgcagcgatggcatttggtaaagtcttttcattcggaccgactttccgtgcagaaaagtctaaaacgcgtcgtcatctaatcgaattctggatgatcgagccagaaatggctttcatgcatcaagaagaaagcttggaagtacaagaacaatacgttgctttccttgtacaaagcgttttggacaactgtgattatgcattagatgttttaggcagagatcgtgccattcttgaaaagtatacgaaattaccattccctcgtatttcttatgatgatgccgtagaactattgaaaaaaaatggctttgaggacattcaatggggagacgattttggttcgccacacgaaacatttattgcaaactcatttgatcaaccagtctttattcttaactatccaaaagccatcaaacctttctatatgaaaccacatccaacaagagatgatgtcgtgatctgtgcagatatgattgcaccagaaggctatggggagatcatcggtggctcagaacgggctacagattatgaattcttgctagaacaaatccgtaaccacggattagatgaaaatgaatactcttggtatttagatcttcgcaagtatggctcagttccacataccggttttggtctaggtcttgaacggaccgttacatggctatcaggtatcgaacacgtgcgtgaagccattccattcccacgcttattgaatcgtatttatccataggggatattaaaagccagcttctgggtaggaagctggctttttttggtaaaaggaagcaaggaatcttaggggaatgaaggtgcgagtttttggatttatcaaaagatcaccatatgccggaaggtgtaacttttattgaaatataacggttttgttacatttattttctttttgcttattatcaggtaaaataagaactaatgtaaataaatagaggttatttatgattaaacaaattgcaatttcgttttcaaaaatcgtttacttgtccttagttaaacttttttcactaaggagacgtcctaaaaacaataaaatcgtctttttgttaagttttccatccacaagtacctatgttttggatgctttagttgaaagatacggtaatcgtttggttatttgttataccagcaatgcgcaagaaacgattaaacgatttaatcaagaaagaatcgactgctatcctctgcagtcattttatatcttgtgtactagaatcatcccgattattaaagcgtcgcaaatgattatatgtgataattatttcgcctttctaggggggatgtcttttgatgaacaaacaaaagttgttcaaatatggcatgcaaatggggcaatcaaaaaatttggtttgcaagcccaatatgctaagaaagcaactgctaaggatcaacaacgttatcaaaaagtatatgatacgtttacgcattttgtagtaagttctccgacaatggctgaaatttttgctgaaagttacaatatcgatcctatctttttaaaattcggttatcccatgacggattattatttcaatcggaacgaaaaaaacattcttaaagaaaagaatattttatcaaaagggactaataaaaaaattgctctctatgttccaacctatagagaaaacgactatgagcttccgctggacttcgagcaaattgaagaacaaattggtgatgaatgggtattctatatccatgcccatccccatgataaaaaattaaaaagcttggctaagaaatatccatcttattttattgatgaaatgcaacatgacctaaaaaatttacttattgttgcagattgtctgatcacggattattcctcagttccatttgaattttctttagcgaatccaaatggaaaaataatttatttttgttatgactatgaattatatgatgatcttgtggggatacaagaggccttcaaagatactctggattcttcaatcgtgaaaacgccagctggattatttgaagaaataatgtcctccgaaaaacaggacttcgtggattttaatgcgaagtggaatacgtttgtttctggaaatgcaatgaactatttatttgaatggattgatgaacaatatgaaaactgaagagataatgggaatttttgtggatcaaattacctatgaggatgtaatcaatgatttaccaaattatatcaatagtagtcgtaaaatgactattgtaagtgtaaacccgcaaatcatcactgaaagcaataaatttcctgaaatcgtgcgatttatcaatcatagtacacatcgcatacctgacgggattggcgtagtcttagtttcgaaattaactggtggaaaaatcaaagaaagagtcactggttacgatttaatgttgaaattattggattacgcaaatactcataagaaaagtgcttttttttatggagcaaagccagaagtcctttctgatgcagttaagaacatcaatcagcgatacccagacctgattgttgcaggcgcagtggacggatatactaagatggacgatggaatcttagttgatcaaataaatgctgctcaacctgattttctttttgtagcgttggggtttcctcggcaagagaaatggttggctaaaaatacaaatgcgcttgaggcatcagtttttcaagatgttggggggagttttgatgttttaagcggtcacgtaaaaagagctcctgctttttttattaattgtcatttagaatggttgtaccgttctttgagcaatccaaagaggattggaagaattctacagttgccagtatttatggcgaaaagtatttattggaagatggtgcatagaaatgataaaacaaattattagttttatttatcgaacgttattcaatatagtcacagcaatctttccagtaaataaaaaaatagttttatttgaaagttttaacgggaatatcccttcagataatcctttagcgatttataatgctatggttcaagacgaagagtttgcaaactggaatctttattggggaataaaaaaagcaaatctattagaagcaaaagctatgtatccagaaatgaattttctttctcgctattcaatgaaatggttatgggtagcttcaagggcgggtttttggatttttaatgcacgaatgtcaaactggtttaaaaaaaataagcaaacagtctattttcaaacatggcatgggacccctttgaaaaaattaggattagatatcaaaaatgttgtcatgcctggtacaaatactaaatcctatcaagatagctttatcaaagaaagtaagcgttgggattatttagtagcacctaatgaatactcaaaagagatatttaaacatgcatttgctttcgaaaataattttttagatatcggatatcctaggaacgatcgtttagtgcaagcaaataatgagtttatagtcaaccaactgaaaaaagaactcctaggagaaaaacgaggcaacgtttttctatatgcaccaacttggcgagatgattattttatttccaaagggaattacaagtttaacatgcctttcaaattagaaaaaatgatacaacttcttgataaagaagatttgctaattatcagaccgcattatttagtaaaagattcaatagatatagatgggtatgaaaatcaagttagggtctgtgttgatgaggatataaatgatttgtttctgattgctgattgcttaataacagattattcatcagttatgtttgactttgcgatattaaagaaaccaatgatattttatgcttatgatttggttcattatgagaatgaggttcgtggattttattttgattatgatagtttacctggaccaatttgtaaagatgaaacatcattctataatgcgataaaaaacttttatacagaaaccagtaaaaaaaatctcaatgataaaaaatatctagaattttataataaattttgctcttgggaaaatggagaagcttctctaaaagtggcagaattgatcaaggcaagtaattaaggggatactatatgagtgcagtagggaatattaagttgctgattaacaaagtattaaacagttttgtttcaaaaaatggtagtatagcgtcgttttatgcaaaattaagtacaatcgatataaagaaaaatacgatactatatgaagtcagggatggtcaatcaattgtagactctccttttgcaatttttaagtatttagtgaatgatcccgacttcgctcattatcaccatgtgtgggtaatcaatgatttagattatcctactgttaataaaataaaagcttcttataagaatgttgattttgtagtgagaaactcaaaagaatatttgaaatggcttgcgtctgcagaatatttagtgaacaatgctacttttcaatctttctttgttaagaaaaaagagcaaatttacataaatacttggcatgggacacctttaaaatatatgggatttgatatcccaggaaatcctgctcattcgcaaaatgttgtaagaaattttttaatggctgattatattctatcgccgaatgctcacacaactgaaattttttcaaaaagctatcgattagacggaatttttcctggagtgattttagaaggaggctaccctcgaatagattgcactaattctattcaacgagaagtcatcaaagaagaattagatgagttaaacctcgtttttgatgataatttgccaactattttatatacgccaacatggaaaggatcttctatattaaatccctcaaatgatgaagaacaaattataagagaaacctatcttttaaaagactattttaagggaaaatataatgtattggtcaaggtacatccttatatttacaagacattaagcagaaatgagcgaatcaaacatattttgattccagatagtttggatccaaatgaggtattatcaattgttgatttattgatcactgactactctagcatcttttttgattttttggttacagacaaacctattattttttatgtttgggacagagatttgtatgaagcggatagaggaatgtatctcccagaaagtgtattacccggacctgttgctgagacagtcgatgagcttattgacctgatagaaaaaaaagatatttttgtggatcaatatagacaaaattatcgtttaatgaaagagaaaatttgcaattaccaagatggtaatgtaactaagcgttatgttgaaaggattttcaaaaaaaggaaatcagaaaaaattaaggagatacttcttagaaatgatctgaaaaaacttattatttatcctggtggcatgaaaaataatggaatcacaacaagttttattaatctaagtaacaatatagattatagcaagtatgatatttctattattctgaataaacctgtttccagtgaagaaataaaaaacttaaataagatcaataaaaatgttcgaatgctatttcgtccaggaaattcactttttactagaaatgaattaatcagagattattttattcagctcttttcattgaagaaagggtggcgcttcttgctaccagagaaagcttataaaagagaggctgcgaggattgtaggaaatattgcgtttgatgttgcaattgattttagtgggtatagctttttctgggcaaaattgattgcattcatgaacagtaataagagaattatttttcaacataatgatttattaagtgattcaaaaaaaatcattaatggaaaggctccgcataaaaaaaatctacctgcagtcttttccatttattacttgttcgatcgtattcttagtgtttcaaaagagaccatggaaattaacagaaagaatttaaaagaatttatcacggatggacaaattggttatacgacaaatacaattgatatatctaagatcatgacaagtggatctgtagatagtagtaatccaaacgccaataatcaagaaatatctaattttagatttacaggaaacatcattgccgctaaaacctatcaagtatatacaagcctatcactgctggaaaaaggagtatatttttccaaaacaattacagaagatgacgaaatttatgtacttgcatcaactttttataatatgaaagagtatgcaaaaattacagttaatggcatttatacaggttggattgaaaaaagatttattcaggcttctaacaaaggtatccaaaaggaagaaacaataatagaaaaccgctcaatgattgctacaattaactgcagcaatgatgaaatgatttattattcaatgagtgatttgaatagtattcgctcaccacttaaatatttaaataatacgtatgcttatattagtaaagagcagaaaattaatgacaccagctactgctacattgaaaacagcaatggagaaatcggctggattaacaaaaattgtctttcaaattttcatcaaacgtttcatctaagggctttaataaattattttttgaataaaaatgtcaaagaaaaaacaattgtgttagataagtttcagtctatatttattcaaggtcaattcaaaaataaaacaacaattggatggactgaaccagagccaattgctggaagcgaacaagtagccattatgtttgaaaaagacgatgtagctttatttacaaaaaaagcaacaattaatcagaaggattactattgtactaattcagcagaaggaaataaaatatggattgaagcaaaaaacattgaggaagcaagagtcaactcaatggaaattcaaagtaacttaattgatgaaagagccaagaatcagaagcggataagcggtcctaccatctcatctgactctatcaatttagttaatatgggcagattatcaccagaaaaaaatcaaatcaatttaatcaaggctatcaagcaaattattgaagatcaaaaaaatgtacgtttgtatattttaggagaaggtcctttaaaacttgagatgaagcagctaatcaaaaaacttgagcttgaagaacatgtctttctgttaggacatcaagaagatcctttttcgattatgaaacaatgtgatttgtttgtttttccttcaatctatgaagggcaacctatggtcttattagaggctttaacgttaaaacttcctgttctagctacaaatatccctgcaaatgtttcagttttgggagagtattctacgacctacattgaaggattttccgcagaggatattgcacaagctatactgaatagaatatgcaaattgaatgatactatgagatttagtcctgaagaatacaatagtgccgcactaaaaagtttttatagagaaatagagacttgaacaatgttaaactgaaaatttatgggtaaagaaaaagttatttaacttttactagtatcaaatagaaaggtgctttttatgataataaaacaacttaagaagactaaaataaaaatctctgaacaactatctttatggttttctgaagaataccagaaaaatgaagttgatacatcaatgatattttatgaatcaagagatggtaaaaatatgattgattctccaaaggcaatgtttgattatttgttaaacgatccttcttttaaagattatcaacatatctggagttatgtaccatcagaaattggatgggatgatttggtggaaagatattctgaaatgtcaaacgttttttttgtagaaagaaatactcaacaatatgtatcttatctatctaaaagcaagtatcttgttactaattcaacttttcagtctttttttgttcctaaaaaagagcaaatagttattaatacttggcacggaacgcctcttaagaaaatgggttatgatattgaaaatgcgaatccagctggatcacaaaatgtagttaggaattttttgtttagcaaatatattatcagtccaaacgcacatacatccgaggttttaaaaaatagtttccgactagatggaatcttctcgggcgaaattttagaatttggttatccaagaaatgacgtgctacaacgtaaggataattctgttttaaaacaattgatagatagaggaattgacatagatggaagtaaagaactgatcctctattgtccgacctggaaaggaacatctacattaaatccctccgattctctacaacaaattttggcagaaacatcttttttgagaagtcaggtgggtgaaaagtataacgttttagtaaaggttcacccgtatatatttaataaggcaaaagaagttgaggaattgaatagatatttggttccagatgatttcgaccctaattatgtattgttagtcacagatatattgttgacagactattcaagtatttattttgattttttggtaacgaataagccaataattttttattcttgggatagtgatatatatgaatccactcgaggaatgtattttgatgaaaatgaattgcctggtccaattgtaagcacgatgagcgatgtaattgattcaataaataagattgatcagataaaagacgagtacagagaaaaatatactgttgcaaagaagaagtttgttagttatgaagatggtttttcgacggagcgagtgataaattatatttttaaaaacaataggagttccgttggaagtgtcaaaaagatgttaaataacaaagaaaaaattttgatttatacaggaggtatgcaaaataatggtatcacctctagtttactaaatctattgaaaaatattgattatcaaaaatatgatgtgacgtgttttatgggtaatccaaatactagagaaaagctggcaaatgttgataaaattccaaaagaatgtcaccttattttcaaaccaggctatgctattcttactccagaagaaaacaaaacacttagaaacattacatcaaagaaaaatgtagataatataaacagcgagttattcccttggaaaggatttgaaagagaggcaaatcgaattttttctaacaacgagtttgatgttgctatagatttctcaggatatagtttttattggacgaaatatattctttcttcaaactcaaaaaagaaaatttgctatatgcatagtgacatgaatgctgacagacaaaaaatagtgaatggaaaacaagttcattataagagcttaggacaactatttagcgtgtacaatcgttttgacatgttacttgcagtttcacctgtaatggcagatgtaaacaaaaattctttgatcaacttcattcctgaagaaaaaattagttttgttttgaattcactagatttagataagctatatggtgatgatgttatatctactgaaaaaagaaatgtcaacataagaaaagtaaattttgaaattgatttaattgacaagcaagatgttattgtatgggaaacgtacaaacaagaattcagtaaaagaatcccatataaaaaagatatgaaaataaaagcaatcgcatatgcaaagtataaaaataacgaattatataaaattctaatggatgatatttatgtggggtgggttgaagcagaaaagtttgtaaaaaattatcctactatagtatcaaaagagccgtataagtcatatggatatataaaaaatgtgaaaaacaaagtattttggatagatttacctacgagtgattctagtaaaagatatggaacgactgatttttataaatatatgtatgttaaaattgttgaaaaagcaattttaagtaatggagatatgtatttccacattactattaataatgaaatagatggttgggtttatagcaatgtaataaatgaaacaattaaatttagtagaatcagaaaaatcaaaaatatttattctaattttcatagattaaaaaacccaaaacaatttccattgctgactcttaatgaagagggatacgtgaaggtaagagatatagctagtaacgatgccttcgaaaaagctgctaataatgaggatgattttgacttttctaatgtaaaaaataaagttcttaaatttaccaaaattattaaaaatcattacggagtgtattatttgatatatgatggaaataaaaaaattggttggttaaataagaacttcctaattgatctcatcgatgattgtatcgtgtcggagaaaaaagtaagtattgaaatctctatagaacaaggtacaataaagtacacagattgtttttttagtaaccctattgttaataacagttctaatacagtaatagttcattctgttattgaatccaccaaaggaactttcttttctgatggggaaaacttttatgaaacaaaagatgttgaagtcataaaagaatttggtaagtatgatctaatggggaactttgttcctatgcctaaaaatcaggattttaacattataacaatcggaagactatccgtggagaaacaacaagacaaattgatttatgcttttcaaaattttaaaaagactatcccgaatagtaaactgtatatattaggtgatggtatcttaagagaagaactgctatctattgttaaagaaaataacttagaagattctgtatttttattaggacatgtatctgacccatttacaattttaaagcaatgtcaactttttactttaacatcagcatatgaaggacaacccatggttctacttgaagcactatctctgggaataccagtttgttcaactaatatacctgcaagcaagtacgttctttcagatggaaaatatggaattctatcagattctaacgatattgatggtatagagggcatgctgtttgagtcatatagtcataagcaaaattttaaagagtttgatgcaattaagtataatatagaagcagtgaatatgttttatgaaaaaataaatagctaaacagtgaattgtaaaagaaaattctatataaaaaattgtttcgaaggagaaagattttatgaagtactttgtatctggtggcgctggttttatcggatctacattagtaaacagattaattgaagaaggtaatgaggttatcgtggttgatgatctttctatgggaaatgttaataatcttattgataacaaaagattgacatttttcaaggcagatataagggatatagaattggttagagaaatatttaaaaataatagtttctcttatattttccatctagctgcagttgcaagtgttgccgattcgatagagagaccatttgaaacacaccaagttaatatggaggctacacttgacttactggaattagcaaaagagacccagaaaaatctaaaaaggtttgtttttgcttcttctgcggctgtttatggagacgatcaagtcttacctaaatcagagatttcgagaataaagccgttgtctccgtatgcaattgacaaatactcgtcggaacaatatgtattactttataatacgctgtatgggttaccgacaagtgctgtacgattttttaatgtttatggtccaaatcaaaatccttcttctccatactcaggagtgttgtctattataacgaatcatttcaaaaaaataagaaataatgaaaaagatgtgtttacaatttttggagatgggagtcaaactagagactttgtctatgttgaggatgttttgcaagctctaaaattggtatcagaaaaagaagaagcactaggagaagtgtttaatgtagggactggcgctcctagttcgattaacgatgtacttggtatatatgaatccgaaatgaatatcaagcctataattcagtttgaagagtctagaaaaggtgatattaaggattcggttgcagatatatcaaaacttaagaaaattgggttttcacctaattatagtttagatgaaggaatagctgagtatttaaaagaagaaatacaatattgataaatgttaaatagttgtggaatggagtaaatctcaatgaaagtgacaaggtccaatagttcgaaatctctcaatacggaaaagatattctcctttatgctagtacttctttcatttgttttaattttactaactttgaattcaaatgttttttcaaataggatagacgctcatgattcttccatgtttctttatttcggaaaaggaatatcggaaggattgataccttataaagatatgtttgatcataaagggatagtattattttttattcaatatatagctaatattgttggattgggcaatatatttttgggaatatttttagtggaggcagtttttttattaattgctttaatttttctttacaaaacaagttatcttgtttcaagaaatcatttgatatgtggagttgtaatattgatttcttctggattattttctgaattatacgaaggtggaaatctttctgaagaatatgcattaacttttatctctatctcaatgtactactttctgaaagagataatcggtgattcattaaaaagttaccattactttcttttaggtctaatgggtggtttagtattttttatacgtctaaacatgatttctctttgggtagtcttttgcataggaatagccgtaagagaaattataaaaaaaagttttgtttctctttttagaaaagctttttacatttttcttggtggaatgtctattgttttgctcattattgtattctctataatgacaaattcagttgaggaaatgatttttcaaacattcacattgaacatgcagtactcttcaacatctctaaaagaacgagtggcagcgtttatattcttcttcggtttattttcagtatatggtctgcctatttggtttacagttttgttttcaaaaattgttattaaatatagagaaatagaggtggagaagcggtctgttattgttttaatcctaatagcactgattttaaatctatttacgattgttgtctctggtagaaattatcgtcattacggaatcacggaaattccttttctgattgttttacagtgcatcgcaatgggattttactcaaaaaaatttagtaggaagaaaaatcttatagttatgtttgtatttcttttttccatgctacctatattcttgccaaccgtaggtgaacgtattaataatgttaatagaaaagaaacgccttcatatcaatcggaacaattagatattgccagatatataaaaaatcattcgaacgaggatgaacaaatttatgttcatgcaattgatgcaaatatatacttacaatctaatagattctctaattccaaattttttgtgcttccttcgctgaattatgaagaatttccaaagttaaaaaatcaatttacaaattctttacaaaaaaatcctccaaagtttattgttatttcaaaaaattcattcttagaggagcatccaaacgatagaaaactaaataagattttaattgaaaaaatcaaacaagattatcacaaagtagacgcattcgataagagctactatgtttttgaaaaacagtagcttaaaatcggtgagattttcatcaatacaacttacaataatgttaaactagagtacgaaaaatatttattttattccactcctcctaactttcgtgtataatggtacaagtcagtattacgaaagttaggaggagttgttttgagtaaacaacatccagaagagaagtccttcaaagacgaagttttaggtgctttgaaaaaacctcaaaccaacgaatcgtctgaacaaaagcgatcatctgttgaggaacctatagaaagtcgctctgcgacccgcagtacaaaaaagcagagcagtatccaaaagggccaaatcaaaaataaaactgttcaaaaaaacgctcaaaaagcgaagcgttcagctcctaaaaaggaagaagctggtttagatgaaaagtcagataccgttcgtaagttacagcggaaaagagaagaccgtatcgtcaatcgcatcgtcacaattgttgtaatcgcattaatcgttattggcggcgtccttggtttttcagtctatcgatatgtcacttcaggattgcagccgttagatccagaaaaaacagaaaaagttgctgttgagattccaagcggatcatcaaataaaatgattggcgagattttagaaaaagataagatcatcaaaagtggtatgatctttaattattatacgaaatttaataatctgactggtttccaagctggtaattatcagttttctccaagtatgactctggatgaaattagtgcccagttacagcaaggagaagggtcagtgacatcagatgcgaaagtgacgattcctgaagggtatgatatagaccaaatcggagatgcgcttgccaaagcaacaagtatctcgaaagatgatttcttagctttaatgaaagatgacaccttctttaataaaatgcatgaagcatatccagagttgttggatagcgcggcaaaagcagaaggcgttcgctacaagttagaaggatatctcttcccggcaacttatgactattataaaggaaacactttagaagaagttgtgacccaaatgatcgataaaacaaatactgttatgtctaaatattacgatcagatcgcagaaaaagaaatgacagtgcaagaagtgttgaccttggcttctcttgtcgaaaaagaaggtagtaaagaagatgaccgtaagaacattgcccaagtcttctttaaccgtctggcagtggatatgccattgcagtcagatatttctattctctatgcgttaggcgagcataaagagttggtaacttacgaagatactcaagtagactcaccatacaatttgtatgtcaacacaggatatggtccaggaccattcaataatccaagtgagcaatctatcaaagcagtgttggaaccaacaccaaataattactattattttgtggcagacatcaatacgcaagaagtctattttgcagaaacctatgatgaacatatgcgtttagttgaaaaatatgtaaacaatacttcgaattaatttttattaggatattagtttacatttaaaaaaaaccatggtaatcttttgtggactattcgcaaaagattaccttttgcagttgatacgaagttaaaaggagaaattaaaatggtagaaaaagtatacccaatgacattagaaggaaaagaaaaattagagcaggaattagaagaattaaagacagtcaaacgtggagaaatcattgaaagaatcaaagttgcccgcagctttggagatctttctgagaactctgaatacgaatccgcaaaagatgaacaagcctttgtagaagggcgtatcaccacattagaaaatatgatccgttttgctgagatcattgataatgaaggcgtagacaatgatgaagtatcgatcggaaaaaccgtcacgttcattgaattacctgatggagatgaagaagaatatacaatagttgggagtgcagaagcggatccattttctggtaaaatctcaaacgattcaccgatcgctcgtgcattgattggtaaaaaaatcaatgatgaagtaacaatttcaacaccaggcggagatatgctggtgaaaatcacagaagtgaaaaaaagctgattttttcgtaaaagtctaagcagaagatcctgatgatcactttctcaaagagaaaaggaccaatcaggatcttttttcggactcgcgacggatgtatgccatcgaagaatccgttatgataaaatagaatcattgggaggaggagcttacatgaaaagcccttggcgttttttctttgtcgtagaagcattattatttctatttgcggtctggcaaattttatcgaatccaccgttattgattttattgattttaggtgttgtgacgatctactttgtttctcgcagagaacgtaaaacaaattttaataattttttgatggttaccggtggtatcgccatctttatcagtcttttaaatagtccggctttgtggctgatgttgatttttgcgatcctttttattggattgaaaggtgtggaaatcactggtgtagattttacaaaaaacacattttggcgcaaaaaacaaatgatcattttagaaacagaagaaccaaagcagtttcatcctcataaaacgaaacaacaatggatcggcaatgagcggatcgggaatcaagtgtatgaatgggatgatatcaatatcgacatcttttctggagatacgatcattgacttgggaaacacattgttgccgaaaaaagaaaatatcgtaatcgtccgtaagggattcggtcgcacgagaattttagtccctgctggggttgctatcaaaatggaacatagcacctttatcggtacagtgattttcgaaggcgagtcaacaggtctgaagaatgagaaagttacgatctacagtccggattatgaggaaaacacccgccgactaaaaattttaacgaacactttgattggggatatcgaggtgattcgggtatgattgctaaattttctcgaggaatgatcgctttttatagtgcggtcactagttttttgatgatgatcttgattcttttttcgtatctttatgctagtggaaagaagaattggctgctagaagtctttcagatcaaactattctttataccgatcatttttcatttattagttgtttcgctgatggtgggcctggctgtctttctattgatttctcttttcagaaaccgccaatacgggccaatcgaagagaagctgcgattgctttcaaatggagatattgatagtccactacttgacacacctatccctcatgcgcaagaaaatcggttgattgaagatgtcgatcgagacatcaggaaattacaggtcaaaatgaaagatatgtcaagtgagcttcaacaattaaatgctcggccgcagctagtggatggcagtacaaaagaagaaatccttgaagccgaacgacatcgtttggcccgagaattgcatgattcagtttcacaacaattatttgccgcaatgatgatgatgtccgcattaaacgaacaagccatccgggacgatgccccggaaatgcaaaagaagcaattggctatggtaacggacatcatcaatgcttcgcagtctgagatgcgagcgttattgttacacctgcgtccggtcacattggaagggaaaagcctcaaacaaggaatcgagcaattattaaaagaattggaaacaaaaatcaagatatccttgaaatgggatatcgaagagtttactatgccaagctctatagaagaccaattatttcgagtgattcaagaattactatcgaatacactgcgtcatgccaaagcggatgaacttgaagtctacttgaatcatattgaacacaacgtgctgttgcgcgtgatcgacgatggtgtaggattcgatgtcgacaatcaaaaagctggcagttatgggctgatgaatatccgtgagcgaatcagtgccgttggcggcacattaaagataatcagttttaaaaatcaaggaacaagtattgaaataaaaatcccgctgcttaaggaggcataaaaatgatcaacgttttgttagtagatgaccacgaaatggtacgtttgggggtttcttcctacttatccattcaagaagatatagaggtgattggagaagctgaaaatggcaaaatcggctacgaaaaggcattgtctttacgtcccgatgtcatattgatggatttagtgatggatgaaatggatggcattgaggcaaccaaagccattctatcagattggccggaagcaaaaatcatcatagttactagttttattgatgacgagaaagtatatcctgcaattgaagctggtgctgccggttatttgttaaaaacatccactgcacatgaaattgcggatgccattcgtgcgactcaaagaggcgagcgggtgttggaaccggaagtaacaacgaaaatgatggatcgtttaacaaatcgcacgccgattttacatgatgatctgacaaatcgggaaaaagaagtgctgcttttgattgctgaagggaaaagtaatcaggagattgcggatgagttgtttattacactcaaaacggttaaaacccatgtatcaaatatattgtcgaaactagaagtggaagatcgaacacaagcaaccatttatgcctttaagcatggcttgacaaaataagaatctcatcataagggtacctcctcatagtcagttgaggaggtttttgatatactagagtaggatttgtaaggtaaaggagcgtttaatgtgaagcagaattacgcgattattggtcttggaaggttcggcggcagtatttgtcgaacattgatagaatccggacaagaagtattagccattgacagcaatgaggatcgggtcaatgagtatatgaatattgctacccatgcggtggtgggcaatgcacaggatgaaatgacgttgcgctcattaggaattcgtaatttcgaccatgtgatcgtagcaatcggtgaagatatccaagcaagtattcttgtgactttgatggtcaaagagatgggggtaccgaacgttttagcaaaggcgcaaaatgaatatcatgctcgggttcttgagaagcttggtgctgatcgagttgtccacccagaacgggatatggggattcgtatcgctcacaatctagtatcaaaaaatatcttggattatattgagctttcagatgaattttcgctggcggagattcgtgtctcaaatccgcgtttctttaataggtccttacttgatttgaattttcgtcaaaaatatggattgaccgttgttgctattcgtcgaggacctggacaagtgatcgtgtctcccgcagctgattcgatcgtgcgtgagaatgataatctactcgtgattgggaacacggatgatgtggatattcttgatgaacatatgaatgattaggagtgaaaaatgatgaatataactattacagaagccgcaattgattggttcaaaaaagaactgtcagtcgaccaaggaagcggcgttcgcttttttggtaaaatctatgggaaaactcagatccatgatggtttttcagtaggaatgtcagtagataaacctgaaaatcctatcgttcaaaagacagtttcagacatgcttttttttattgaggaggccgacgagtggttcttcaaagggtatgatctacaagtcgactacgatgaaaagctagatgaacctaaatatagttttactgaaaacaattaattaaaataaagatacaatgtaacagtatgagtctatgactgaagtttagtggattccatatcgctagctttgatcatagacctgttcgttaggagatgaaaccatgttatcaattatcgtaccttgctttaacgaagagagtagcttaccacttttttttgaagagactgaaaaagtaaaagatcaggtaggcatgccttttgaatatttgtttatcaatgatgggtcatccgatcaaacactcgcagtgatgcgcaagctgcatcaagagcatccagaaagtgtgcggtacctttcgttttcacgtaattttggaaaagaagcagccttgtatgctggcttaaaagcagcaaaaggggattttgttaccgtaatggatgcagatttacaagatcctccacgccttttgcctcagatgtttgacttgctcaacacaaaacaattagactgtgttggaacgcgcagagccgatcgcaaaggggagcctaaagttcgtagtttcttttcagaagccttttatgcattgatcaacaaaattggtgaagcacatatggtcaatggcgcacgagatttccgtttaatgcgtcggaatatggtggatgcagttttagaactttctgaatacaatcggttctccaaaggaatctttagttgggtaggttttgatacagaatacattgcctacgaaaatcgtgaaagagtagctggagaaacttcttggtcattctggagcttattcaagtactcgattgatggcatcgtcaatttttctgatacgccattaaatattgcttcttttgttggcgcgttgtcttgtctagcttctggaattgcactgctattcataattattcgtacttttatttttggtgatcctacctcaggctggccttctttagtttgtatcgtattgtttgttggcggtttgcaattgctttgtctaggtattattggaaaatatattggaaaaatttttctggaaacaaaaaaacgtcccctttacattttaaaggagacagaaaaagatcaaaaataatttttgggaataaaaaagcagcgctggttgatgatcaatacccttttgttacatcgacttgatttcgaaccaattttttctcgtggataaaattgcggaagttatccataaagatggccatgaatgctttttgaaaatgtggggtcaacccggaaatatgcggggtgatcaacacattttccagtgtccatagcggatcatttgcgggtaaaggttcttcttcaaaaacatcaagagccgcaaatgcgatttctttttggcggagggcttctgtcaacgctacagtatctacactgggtccacgcccaacattataaaaagaagcggatgatttcatactattaaaaaaatggctattatagattcttgtagtttcaggtgtcaatggtaagatattaatcacacaatcagctttctgactttgttcaatcaactcttcaagtggataagtttccttgaaaccatcaacggcatgccccgttgtatttatgccgacaggttgggtgccaaaaaaatttaaggcctttgctaaagcctgcccaattttacctgtacctgcgatcagtatttctttatcagataataatgaataaggaataccattgggctgccattgtctttcagcctgttttttgatggcggtaaaaattcctctggattccatgaataataaagcaattaaatgatcagtgatcgattgtgcatgaatgccgctaccattagaaagtaagatgttcttttgggcaaactgtgctagaggtagcgtatccacaccggctgaaatggcttggacccattcaagagaagcattagccagtaactttccagcccattcttctttccagccaatcgtgattgcaacatttgaccagtcgatggaagttgcttcatcatagtggataaactgatattcatcactgatttcattaatttgtgtgataaattcatcacgaaattctctgctagataaaatatatttagtcatatttgttcctcctttattttagtgtatcaaagaacaaagaaaaaaccatgcgcaaagatctatgcatggttggatagttactagctttttaattggattttaggcgaacctttgacgccttgagtgaatagaaacagtgctgcgaataagataaatgttgtcccatcaaaatttggtacgaatagttggatcagcacactcaaaattgttggtaaagcagcactaacgattagtatcttaaggttttcaaaaaagctgtaagaaaaaagttttagttttgtatagatagttgcaataaatgtacccatgatcaatgtgattaataaatttaaaaatgtagggtagagcgctactaagaaaacaataagttgtagccaccaaggaatttgattgctgctcagtgtttcccgaatctttttgccatctaaattattaaatgctggttcattataagaaaattttaattgatttgtatctaagaatgatgtggaaagtcctgttccagggaaactgacaacaatttctttttttaatagtcccacactcaacacatttgcagtggcatctgaagcaatatcggtagcgttgcgttttccttcagggtcgaaagtaaaaatgatagagtcggtttgatagataaacccttctccttgtccattcgttgttaattgaccattttcaatcgaaaaattggggattttttgcgcaattttttgactatctcgctggaaatcctgaaagatatcattgacttgcaaagtgattggtacggctaaaataacggtagctccaagtagaaaaagaatcacttttgaaaaagcagcgtcttttacatatttgagatttgggattcgaataaatgcactttttagcatttgtatgattgtcatttgtttaactccttttatgtaactaaaaataattgtaacgaaggcagcaacagaacacaaggacttatgacagaaaagtccgattatctctaaagtgttctttgctgattaatgagtagaattggagatcgagtatggaaagtttaaaaaatgtgaaaaataaactacaagaaaaaaaattatgggagccgttaacgtatttaatttttggtggattaactactttggtcaatttagttgtttattttctctttagagaaatctttgattttcattatatgattgctaatgtgatttcttgggcagcttctgtgttgttcgcattcttcacgaataagatttgggtctttgaagcaaaaagtgaaacaaaaaaagaatcgtggcttgccttttggaagtttcttttcttcagagtcctttcgctgggattggatatggcttgtatgtatctattgattagcgtactaggaaccggtgattttatcgctaagcttgttacacaaatcattgtcgtcctagcaaactatgttttcagcaagtttctgatttttgcaccaaaaaaaattgataaaaagtaagcatatgttttgatgaaccactttttatctgataatgttacttatgtaatcactatcactgaggaggaattttttatgtcttacacattaccagatttaccttatgcttatgatgcattagaaccttacattgatgaagaaacgatgcatttgcatcatgacaagcatcacaatacttacgtcacaaatttgaatgcagcaattgaaaaacatcctgaattaggtgaaaaatcagttgaagaattacttgctgattttgattcggtgcctgaagacatcaaaacagctgtccgtaataacggtggtggtcatgcaaatcacagctttttctgggaaatcttggcaccaaatgctggtggtgaaccaacaggagccatcaaagaagccatcgaagaaacatttggcagctttgctgatttcaaagaagaattcaaaacagcagcaactggccgctttggttctggctgggcttggttagtcatcaaagatggtaaattagcgatcacttcaactgcgaaccaagattcaccattaatggacggtcaaacgccagttttaggcttagatgtttgggaacatgcctactacttgaaatacaaaaatgtacgccctgattatatcaatgctttctggagtgttgttaattgggataaagtaaatgatttttatgcgaaagcaaaataatcattaagtaagggaattatttttaatcagaataaaactatcccaacgataaaagaaagcacgttgcatcttagcatcagcttcgtgttaaccataagttctcactgctacctttgattcgttgggggtagttttattttttgaaacatattgctaacgctttcattttcagctataatattgaagacggaagcgtcttattttaattactggaggatttacacgcatggaacatggaaaagtaaaatggttcaataatgaaaaaggttttgggtttattacagttgatggcggagatgatgtctttgttcatttttctgcgatccaaggagatggctttaagtctttagaagaaggtcaagaagtcgagttttcgattgtcgaaggcgcccggggaccgcaagcggcagaagtcacgaaaatctaaactagaacaagctgagggggacctcagctttttttaatttgctattttcggccaaatttgttatcttcagtgtattataaatagattaaaaatgagggatatttgatgaaacgagtaattacgtatgggacatttgatttgctccattatggtcatatcaatttattgcgccgagcaaaagaacaaggagactatttgatcgtggcattgtctacggacgagttcaattgggatgaaaaacagaagaaatgctacttttcttatgaaaaacgtaaacagttattagaggctattcgctatgttgatttagttattcctgaaaaaaactgggaacaaaaagtttctgacgtcaaagagtaccacgtggatacttttgtcatgggtgatgattgggctggtaaatttgatttcattcaagaagaaacagatgccgaagttgtttatttagctagaacgcctgaaatatcaacgacacagatcaaaaaagacttaaaaataaataattaatacttaaagcataaaaggtatctttaaatggtgcctttttttgtacactatttccgtttttttcttaaaatttattagatgtttttcgttgtttattttgtcttagaggaaaatatgatatgatgtagcttgagttgtagcaaatgaatagaatttctttgagaatggatgaagaaagtggaaaaagaaataaaagttcgtagtactttggttacaaaggaatatgacctatacaaaaagaaatcagacaaagtgaaagcattattcaaattttatcatcgaaatgttccacgtttttgggcattaaaaggcgttagttttgaagtgcgtgcaggagagtctgtagggatcattgggataaatggttctggaaaatcaacgctttcaaatgtgatcagtggcattattcctccaacatcaggcacaatggaagtcaatggcgatacgtcgattatcgcaattggagccggattaaaatatcaattgacaggtttagaaaatattcgtctaaaagcattgatgtctggaatgaccaataaagaaatcgataaaaaaatggatgaaatcgtagcatttgccgatttaggtgattttattaatcaacctgtaaaaagctattccagtgggatgaagtcacgtttagggtttgccattgctgttcataatgatccagatattttgatcattgatgaagctttatctgttggagacgaaactttttatcaaaaatgtgtggataaaatcatggaattcaaagagtccggcaagactattttctttgtcagccatgctttaggacaagttgaaaaattatgtgaccgtacaatctggatgcattacggcgatttgcgcatgtttggtccgactgaggaagtaatggcggaatatcgcaagtttatcgactggttcaagaagcaaccgaaaaaagaacaaaaagcttaccaagataaatacaaagaaaatcaaaaggcatttaatctagaaaaattagctgaaaaaagccaagatgatagcttgctgaaagagcagcatctatctgaacaaatgattcagaagaaccttaaacgaactcctttaggtgagaagatgacgattccaactaaaggacttttgactcttgcgatagtaggaacactgttttgctctcttgtttctttcagtggcagatccattagctatgcgctaaagcatccggttgatgcaattgtacaagttttcaagtaaagataactatttctttatttagtttagatagaaaaggaagagtttagtgaaagaaattgctgcagtaataaaagaacaatttaatcatgcgggaattattttccgtatgtctcgatacgaggacaaagcaacctatcaaagccactatcttggtcttgcatggcaaatcttgaaccctgcgattcaaattggtatctattatttagtctttgggctaggagtcaatggtaatcggaaagtagatggcgtaccatttattatttggatgttgattgggatcacagcttggttttatatcaattcttcggtacttggagcgtccaatagtattcaccgacaagttggtatggtagccaaaatgaaatttccagtaagtatcttgccgtcaatcaatattatcagtaacttgtcatcttatatccctatggtagctattgtgattggctcgctcttatgggcgggagtaacaccgtccgtttattggttgcaatttatttattactttattgcgatggttattttcttatttgctttcggattattaaatgcgaccattacagtattgatacgtgactatcatattttcttacaatcagtattacgtttgttgttttatgtttcaggaccaatttgggatatcaataatcgaaatatgccggaatggttaattaagctattacgtttaaatcccttttattatttgattgaaggctttagagatgcctttttatcacgtggttgggtttgggaaaaaacgacctacaccttaattttttggggaatgactttaacactattgataataggtagtcatctacacatgaagtttagagcgcgatttgtggattatatttaagtataaaaaaactatttttcaattaatacaaaaaactatccgaaggaatgaaggggtctgttaaagcgtgtctcttactttccttaggatagtttttttagatgtgttaatgaatagggatgtacgccgttaaaagttaaaataacaaattctttatcgtttcatttttgttgcaatcgtgttaagattctgtaataaaacagaagcaagattgctgaatttgtaaaattgtggcaaaatttaaacgattacctaataatgttgtgatagaggtgtaggatgcgtttatatcaaaaagtaattttaggattgttgggcttggtggcagtaagtattgtcggtgtcactgtctatggaatgaaagtatacgatgatacgaataaaacgttcaataatattacgcaaagtgcggatcgtaagacgaaaaaacgtgaaacggcagtaagtattgaagatagagaacccttttcgattcttttgcttgggattgatactggagcgttggggagaaccgaacaagggcgttcagatagtatgatggtcgttacggttaatcctgccaagaaacaatcaacgatcgttagtcttgaccgtgatatctacactcaaattgttgggtatggcatgttggataagctgaaccatgcatatgcctttggtggcgaagcaatgtcgatggattccgttgaaaatctgttagacattcctattgaccattatgttacgattaacatgcaaggtatgcgagatttgatcgatgcagttggaggcatcgaagtcactaataaaatcgattttactctggaaggagtgcatgtgcctaaaggaaccattactttagatgggaaaaccggtcttgcctatgcacgcatgcgaaaacaagatccggaaggcgacattggacgtcaaaaacggcaaagagaagttgtcactaagatcgttaaaaaagtaatgagcttggatggcgtcagcaattatcaaaaaatattaaaagctgttgaaaagaattcaaaaacagatttgacttgggatgacatgatggatatcgctaccaattatttgcctgcgttcacgacaatcgatcaagaacaattgcaaggtgaaggccaaatgatgaatggggtctattaccaattattaggtatcaatcaattgctggaaatgcaaaataaattgaaagaacaactgaatcttcctaccagcgagactttgtctcaaggagatgaacatactgatggttatacaaactatcaattgtacgacgatacgaattacaatagtgaagaaaactcaaatgagaatccaggtgaaccgtcagacatttatgatgatggagccgggtatcaggaagatactgtcgattactctggatattaataatgaaaaccaaagcaaacggtcattgatcgtttgctttttacttttccacagatggaagttagaaaaatgtgtttcacgggattaaaattggaaaagattaagaaagcttaaagtgtagcagattctttctcaacaaaaaaatctttttgcgtaactgtgaaacattacagtggatgagaacgaattcttataattttctctaaggatacttggataattttgatttcttctgtttatattgaaaatttttggtaaaataagacggtaagcagtttgtaatgagaggatagaagagatgaagaatctaaaagataaagtcattaagaatatacgaaaagggcctgaggagcctaagacaaaatcttatcgcaaatcccatgttccctttcgattgaattttctcttttttgtgatttttggtctttttgttgcgttgatcgtgcaattaggttatttacaaatcgtcaatggtgataatattgagaagcaattgaaagcttcatccgtggtagaagtcaatggcagctctccacgaggaatgatttatgatgcatctggcaaaccgcttgtcaaaaatcaagccaatgcagccattacctttacaagaggaaataagatgacagctgaagatttattgaagactgcacaaaaactagctacattgatcgatattccaatcgataagaatctgacagagcgggacctaaaagatttttggttggcagatcctgaaaatttgaagaaagcgcaagatcaattaagttccaagcaaaaagcgctcggggcttctgatcagtatgcggcaactgtcgataaagtaacggatgaggatattgcctttaatgatgatcagttaaaagtagcttccatttttaaacgaatgaatagtgcacaatctttaagcactgtttatttaaaaaattctgatgtatctgatgaagaactagcaattgtggctgagaatatgaccgaacttcccggagtttcgactggcacagactggactagaaaaattgttgaaggcagttcattggcaagtttgatcggaactgtgacaacagaagaacaagggatccctgaagaaaatttggatgaatatctagcgaaagggtatgctcgtaatgatcgtgtaggacgaagttatttagagaagcaatatgaagaagtccttcaaggatcaaaatcaaagtctcaaatcacattagacaatagcaataatattgaaagccaaaaagaaatctatgcgggctctaagggagataatcttgtactgacgctagatgccaagttccaaaaagaagttgatgaaatcttacaagataactttaagtctttgatggattcaggagctgcagaatactcgcctggagtctatgctgttgcgatcaatcctaaaactggcgggattttggcaatgtcaggttatcaacatgaggcagaatcaagcaaattgcaagagaatgcaatcggaaccttcatcaatgcttttgttccagggtctgtagtcaaaggtggtacgttagcagctggttgggaaaatggtgtcttgaatgggaatgaagtcttatatgaccaaccaatccgcatcggctctgatgtcaaagcttcgatctttaacccgacaggagcaaacaaccgcaatttgtcagctgaacaagccttagaagtttcttccaactcctacatgatgcaggttgctttacgcttgatgggcattgagtatcagcctggaatttcaattccaacagttgatcgtcaaacagaagcctacagtaagctgcgtacagcctttgcctcttttgggatggggacgaaaacagggatcgatcttcctggcgaagcaacagggatcagcacacctgtcgacaaattagatacggtcagtgatggcggtaagatcctggacttagccttcggacagtttgatacctatacgacattacaattggctcaatatgcagcaactgtggccaatggcggccaacgattgcagccacatatcgtttcgggtatctatgggaatgatgaaaccggtggtttaggaagcttgaaatcagcggtagaacctaccgttttgaacgaagttggtttaactactgatcagatgaaaatcattcgaaatggattttatgatgccgttcatggaacagatgcttgggctacagcaacaggactagcttctgctaaaatggaactttctgcgaaaacgggtactgcggagacaccgattgtcgatgaaaatggcaaaaccatcaatctggtcaacctaaatattgttgcttatggaccaagtgatgatgcagatatagcagttgcagtggttttaccacaggttaaatcttcaactacttcgcatccaaacgtaaaaatcgtgaaagaaatcatggatgcttactatgatttatatatgaaataagcaaggcataatcgttgaatgagtaagagggagttgatgaacggttcgttcgctgatgattttccaaatcagtgaaggacggttcatcaactttttttatagcaaaatactttctatcggaattattaagagattatcaataattcggagagaaacctcttttttagtaagtgggtcttgctatttttggttgaatggcatagaatactctcggtcaacaagaaatgaaaaagcaggattggtttcaatcatttttcattttaactgacttctattataattgactagaattgcagggggctatcatgacgaagcaatgtttaacgaaacaagaattgatggaacgcctaggggagttctcaccagcagaaaaaaaagaaatccgcgaatatttgcaacggaagaatccattgctgtttcgcaaatttgaacgcatgaaacatgaattatttcgtctagaatcaagacggattcaatgtgaaatcgaaaaaaatgaaaaggagttgaatcagctcgatcataagattctcatgaaaaaagaacattttcttgagttattaatcgcaattcgaaagaaaagaggataatggatggaatttattgaacttatcatcatcatcgcgatcctcgtgaccttttcaaatattgtcagcaaaatactgccatcagtaccgattttcttcattcagattatcttaggcattctgctaggattgactgaaatgggacaagaaatcgcattcgaaccagagatgtttctagtgatgatcattggaccgctattgtttcgagaaggagaacgagccgatgttccggaaatcttgaagaacagtaagatcgttttgtttctggcctttggcggtgttttgctgaccttatttgcagtgggaacgacactgcattggctgatgccatcgattcctttggctgcttgttatgcttttggcgctgccttaggaccaacagatgcggtagccgtctcatctttagcgaaacgcttaaaaatttccaagaacatcatgcatattttagaaggcgaaggtcttttgaatgatgcttccggggtaacagcgctccaatttgctatcgttgctttagtcactggtagcttttctgttatgggggctggctttcaattgcttttttcgagtattggcggcggcttgattggttacttgatcgtttggttaaaacggcggatcattcgctttattgaaaaaatatctgcccaagatgtcactgtttatctgttgatcgaactactattgccttttgcagcctacttgattgcagaaatggttggagtatctggtatcattgcggcagttgttgccggtgtagcgcaagcacaaagaagacgacgagtctctttgttcgatgcggaactagccaatatctctgaaagtacgtggtcaacaattgtatttacgttgaacgcccttgtttttttatttttagggattgaactttcgcaagtattttcacccatttgggaaagcaattcttatgcaaacggtcatttagtcttgaccatcgtagtagtaacactcgttatcttcttcattcgtttcttattccttcttttttattatcagtttttacaatcaaaaaaaatcgtggacttgaagcaagtagctttgttgacctttggaggggtcaaaggaacggtcagcttagcggcaatttttatcttgcctgtaacgatcaacggtgaccaatttgaagcccgcagtttgctcttatttttgacggcttgtgtcatcttagcgactttagtgatcagtgtacttgtcttgccctatttggcagatggtgaagctgccgaatctgttgatttcaatcagttgctgattttagaagaagtcatccagatcttggaagaagaagagaaagaaattacggatgccaaagagcgcttagcgacagatgcagtaatcaatacttatgaaaatcgacgctgggaattgtatcgcaatagtttaactgattctgaaaagcaagagatacaggaaattcaaggattgattctatccattgaacaggatggtttggatgaagcctaccgaaaaggtgaggttagctccaatgggtatcgcttttattcccggttcatttcgcagcagcagcattcgttagcaaaacagttcttgtcttttttcagtttttggcttttgatcattcaacgttttgtacggatcatttttcatcccaagctgttttggcagcgccagcagcagctgaaggatgcattgaaacaaagagatatatcagaagtacaaaaaatctatatcaaaaacagtgattatatttttcatagtttaagcaacttagaagatgtctacgattcatctttgatcaacttctttatacgtcaaagggaaatgagcttaaagcgttttgagcataataacttcattgagactatcatgattgaacaagaaccgatttttgtcaaaaaagttttacgaggctattatttagaacgaaaaacgatcgatgaatatgaggtagccgaaaaaattccaacgatctctgcaaacgaatatcgacgcaacgtaaatctcttggaatcttatgcgatggctcgcgcagatgaacagccgaaacagcgaatgtttcgtagataaaacaacaacttcttcgtctcagggttgagatggagcggttgtttttttcttttttcttaaagaccctgtcatgcttatgtggtacaatgggcgaagaaaaatagatctcaggagggattctgtgaaagaattaaaagtaagtgagcttacaaaaacttacggcgataaaacattatttgatcagctttcttttctgatacatgagaaagaccggattggcttgattggtgtcaatgggacaggcaaatcaagtttactgacgatcttggctggaattgaagccggagatggcgaccgtccctctgtttttaaaccacaagattatcgaatcggctttttggcgcaagaaagtcaattaaaagaagaattatcggttgttgatgcggtcttccaaggaacaagtccattaatcaaaaccgttcgtgactatgagaaagctttgattcagctggaacaaaatggctcagatcctacagtgcaagctgcctacagcagagcagaagaagctatgaataaaacagatgcttggaatacggatacaacggcaaaaatcattttgcagaaattagggatttcagatttaaaacaaccagtcaatgaactttcaggtgggcaaaaaaaacgggtggggttagcgcaagtgttgatcgatgaaccggatttactattgttggatgagccgacgaaccatcttgactatgaagctatccaatggctagaaggctatttgaaaaactatcgcggcgcactgatgatggtcactcatgatcgctattttcttgaccgggtagccaatcgcgtgtttgaactctcttttggtaaactttatgaatatcaaggaaattacgaggactatttattagccagagcagaaagagaacgtattgaagaaacccaagaagaaaaacggcaacagttatataagcacgagctggcatggattcggacaggcgccaaagcgagaacgactaagcaacaagcgcgaattgatcgtttcgacgatttgaaagagaatatgaaccaagtcaagcggaatggagaagtgcagattgatgttgcgacctcacgtttaggtaagcaagtgctggaaatcaaagaaggtagttatgcaattgaaggcaaaccaattctatctcaatttgatttattgattcagtcgcgagaacgtttaggcattactggtgagaatggtgcaggtaaatcaaccttgctgaatgtgttggcgggacgtctctcattagattcaggaagacggattattggctcaaccgtcaaattagcttattatacgcaaaccaatgagacgatggatccggaacagcggatgattgcttatttacaagaggcagcagaagaagtagaaaaaacagatggtgcccatgtcagtgtagcggaaatgctggaacaatttttgttcccccgtttcatgcacggaacaaagatcggtaaattatctggtggtgaaaaacgccgcctatttttattgaaattattgattggtcaaccaaatgttctattgttggatgagccaacgaatgatttggatattgatacattaactgttttggagaactatcttgaatcatttcctggtgccgtaattacagtttctcatgaccgttactttttagataaagttgctgaaaaattacttatttttgaaggcaacgcgcaaattgttcgcttctatggttcgataaacgaatatttacaaaagacagcaacgaaacagggcacaaagaaaactgcagcctcacaacctgacaaagggctacaaagcaaatttgtttccgaaaagccagtcaaaaagaaactaagctacatggaacaaaaagaatgggcaacgatcgaagatgagattgctctgttagaagaacgagtcgacgcactaactgaagcgatgaatcagcagggggatgactttacgaaattacagcagctccaagcagaagttacagaaacagaacaattgttagaagaaaaaatgacacgctgggaatatttaagcgagttttcagacgactaataaggaggcccattatggaacaagcatatcttgatttagggaaaaaaattttagaaacgggaaatgtcaaaggggatcgcacagggactggaaccaaaagtatttttggtcatcaaatgcgatttgacctctctcaaggatttccattattgacaaccaagcgcgtaccttttggtctgatcaaaagcgagttactctggtttcttaaaggagataccaatattcgattcttactgcaacacaagaatcacatttgggatgaatgggcttttgagcggtatattaaaagtgaggactatacaggtcctgatatgactgattttggccgtcgctcattaattgatgaagaattcaatgccagctatcaagaggaattgcaaaaattttgcgaacgtattttaaatgacgaagcatttgcagaaaaatttggtgatctaggtcatgtttacgggtatcaatggcgtcattgggaaactactaaaggggaatttattgatcagatcaaagaagtgattgaaatgatcaaaacaacgccagattctcggcgcttgattgtttccgcatggaatccagaagatgtgccgtcgatggcgctgcctccttgccataccatgtttcagttttatgttcatgaaggtcgactaagttgtcagctttatcaacgaagtgccgatgtttttttgggggtgcctttcaacattgctagctatgcgttattgactcacttgatcgctcacgagacaggactccaagtcggcgaatttatccatactttaggggatgcccatctgtatagcaatcatatggaacaaatgaaagagcagctttcccgaacaattcgttctgcacctacgttgcacttaaatcctgagaaacaatcgatttttgactttgagatgggagatatcacgattgaaggctacgatccgcatcccacgatcaaggcaccgatcgctgtctaacttattacagttgggagtgagaagatagatgacaaacgatttacagcggggaatcgtcgcaacgctgcatattacgtcaaaagataccatttcattatcagatgtagaaaaaacaattacgatccttcgttcttatttttcgcaagtcattttagcagtttctgaagtaacgaaacctgaaatcaagcggtatttatggcagctgccgccccagatctatctctttgaattgccagcagtcggtgctggtccagcacgtcggcaagctgtggcacgcgctggaaaggcatttccgcaactcgcttcctttcaattatgtgattttgatcgtttgatcacttggtgtgaggaatacccagatgaactgtcagctttgagctgtcagccgtttcctacgaacactttctgtatattaggacgtacaaagaaagccttcctaagccatccaactgcttggcagcggacagaaaagctggtcaatgaaattgcagcggaagtttttcatatcaagggtcttgatattaccgccggcagtgtcttgttttctgcggaattgattcctttactagtatccgcagattcttcaagatggacggatggcgaatggccaaccaaagtgaagcatcatggagggcatattttttatcaagcgtgcgaaggcttgtgttataaagaaagaaataccgatcatctgcaagcacagcctgcttatcaattaatgagaaggctgcagattgcagcggctattgcagattcactttatctagaaagggagttttgaaacatgttgattgcactttgggcacaagacaaaaatggtttgattggagaaaacggcacattgccatggcatttgccaaacgatctgaaattcttcaaagaacaaactactggaaattcgctcattatggggcgaaaaacgtttgagggcatgaagaaaaaagcattgccaaatcgaacaacaatcgttttgaccagtgacacagcatatgaagcagaaggcgtattagttatgcatgatcgacaagaagtcttggattatactgcacagcaagatcatcctgtgtttctaactgggggttctggagttttcgaatcgatgatcgaagattgcgatcagttgtatcgaacagtgatcgacgagacatttaccggagatgtctactttcctgagatcgattggtcaaactggcatttggataaagtcatagaaggcgtagtggatgaaaagaacatctatccgcaccggtttgagttttatagtaagcagaaaaaataaataaggcagctgttacaacatatggttgtagcagctgccttatttaagtaaaagtgggttggatcatgtaaaccaaagaacggaaaaatacattagtccagctccgagcataacaaacaaatgccaaaccacatgcatgaagcgtacggatttgatactgtagaataatgcgccgacggtataagagacaccaccgcttgttaacagaaaggtaccccaaaaacccagtgaagcaatcaatggtttaaatgcaatcacgcagagccagcccataataatataaattagtgtggatatttttgaaaccgtctcttttttatgcagtgtgagtgacttataaacgatcccgctgatggctaacaaccaaatcaaaatgaaaagtgtccagcccaaccaaccttgaatactcagcaagcaaaacggcgtataactgcctgcgatcaataaaaaaatcgaggcgtgatcaaagacttggaaaactttttttgctcgtgtgaacatcaaactatggaagagcgtagagaataagaataacaaaatcatcatagagccataaatcgcataggaaatgatgtgaataggggaatctaatcgagcccctttaatcaaaagaataacgagtccagctatacttaatccaaatccgataccatgggtcaccgcattgagtacctcattcagaatcaagtagcgtcgtgtaaatttcatatgatccatcaagcaccttcccttcgaatttaaataagatgaaaaaattttttctctctgttatactgattataaatggtctatggttattttaccacgaaaagagacttgatttaaagagagagtgaatgtatgatggcaaagcttaaagttgtaacggattcctcctgtacgatggagccaaccgttcgagaccaattgaatatccatgtagttccgttatctgtaatgatcgatgggatggtttatccggatgatgattcattgcccggagaacgattcatgcaaatgatggcacaagcaaaagaacttccaaaaacgagccaaccaccgattggccattttgtggaactgttcgatgaattaggaaaagatggtagtgacgttttatcgatacatatgacgaagggtctgagtggaactgtcgaagctgccagacaagcaagtaatttgtcgaaagcaaatgtgacagtgatcgatagtgatacgacagatcaagcattgtcgttccaagtgattcgggcagctcaattagcacaagaaggtaagacattagctgaagttttgccggaagttgacaaagttcgagaaaataccaaattatttattggtgtctctacattagaaaatctggtaaaaggcggtcgaatcagtcgtgccaaagggttattatccagtttattaaatatgaaagtgattatggatttcgaccattcagaattgattccaatcgtaaaaggacgcggtgtaaaaacatttaataagtggtttgaagaattgaaagacgaattgaaacgcatgccgaatgtgaaacaaatagggatctctcatgcagaggggttagagatcacagaacaattcaaaaaagaattgcaacaactcttcccagaaatgaatattccactacttcataccaccccaatcatcgctacccataccggcaaaggcgcattcgccattacgtattacaccgaataattttaatgacagtatccaagcgattcgtaaacacgaatcgctttttgctgcgaatcacaatgattggcttgcgaagcaagacagaattgatgatgagcagtactaggcgagctgagcgagcgtagtaaccttgaaaagaatcacaaagactggcacacgaagagtgacagagcagatggtgagcaacggcgagccaaacgagcgcgatcttgaaaagaatcacaaagacttgcacacgaagagtgacagagcagatgatgagcaacggcgagccaagcgagcgcgaccttgaaaagaatcattatggttgtcactcgaaaaatgacttttacattctttttaatgtaagtttagaagcaactgcagacgaaacaatgagtacaatgagtagccaagcagttgatgaagcgggactcgaatcaagcagatgggtagaaattgcttcatacttcgctgctcttcgttgattgagtttctcgtcaatcaaaacatttcgactatgaatttaatgagaattttgataaaatagcttagattataggttaggagattgaagatccgtgaagtggaaaaaagtagcaatttatctttcagttgtattgatcgtagctttaggtactggaatgctcggtcattttttgattccaaaagcgcaaccattgctcacaccagttgcgagaacggcagaagagggaaagaccaaaaatgtgatcaattacatggccttaggcgattcgctgactgaaggagtcggtgatgagacgcaacaaggaggatttgtgcccatcgttgcagccgatttgcaagatcggtatcatttagcaaatgttgtgacgacgaactatggaattgctggagagcgcagcgatcaaatcctgaaacgagtgaacaaagacaaagaattgcgcagtgacctaaagaaggctgacttgattacattgaccgtcggcgggaatgatgtattaaaagtgattcaaactaatttttttggtttgagtgtcgattcttttaccaaacccatggccgactatcaagaacgattagtagagatgtttgagcagattcgtcaactgaatgaaacagcacccatttatgtgttagggatatataatcctttttatttaaattttccagaaattactgatatgcaaacgattattgataattggaacaaagcaacagaaacatttgtcaaacaacagcaaaatgcttattttatcccaatcaatgacttgctataccaaggactaagtgacgaagttgggatcgcagatacggattcttctgaagcaggcgcttcaggatcagcagaaacttcggataccacaacttccaccaccaacggtatgaccggtacttcagaaactgggggaacaaaagtgaccaacaatgtactgtatgatggggatcgtttccatccaaacaatctagggtatcagctaatggcgaatgctgttcgtgatgaattaatcaaaacccaaaatgtttggctgatgaaggaggaaaaataatgaaacaagaaactaatgatgtggataaaaaaagtccaatcaaaaaaatgaattactggaaaattgcttttctagttttagtaggcattctgttgggaacaactgtcttttttgcttcacgggtgtttcaacaacgtgaatctgggatctcagaaagtgcagaactagtcaaacgagacggtaatcctgttttgaccatcaacagtaataagagtcaagtcaatcaattgatcgatttctatttaactgattttcagaaagatcaagaagtaaaatacaatttcgagttgagaaatgaggcactactgacaggtcaatttaaagtgctgaactttccaatcacattttacttatactttgatccttatgtcaccgaagaaggcaatgttcagttaaaagccaaaagtttatcaattggtactttagatctgccgaccagtgaagtgttaaaaatgatcaagcgcagcttcaagtttccagagtggatcgaggtcaatgcggatgaacaaattattttgattcgcttggatcaattccgcatgcaaaacggcttgtttatcaaagcgaataaaatcaatctagtagatgatgagatccaaatgagtctctatctgccagcagaaacggaggacaaataatggaacgagcaatttttgcgggagggtgtttctggtgtatgattcagccttttgatgagttagaaggagtacagtccatcttttccgggtatacggctggacacacggttgacccgacctacgaggaagtaaaaagtcataaaaccggtcatacagaggctgttgagatcatttttgatccagaaaaaatcagttttgaggaattattgactatttattggcaacagacggatcccacggatgcttttgggcagtttgaagatcgaggagacaattaccgaccagtcatcttctatttcaatgaggaacaaaaacaaaaagcagaagcaagcaaagccgctttgcaagcatcgggtcgctttaatgccccaatcgtaacgagtatcgaacctgcacaacctttttatttggcagaagaagagcatcaagaatactacaaaaagcatcctgaaaattttgctcgcaatcatgcgagacgagcagcttttcttgaggatcactgggagaatacgcatgcgtaaaagtttttatacttatttaatggccatcaaagggcctagtcatactgatgaggcacagatctttgcgacacatgcaagtcatgatattcaattcccaaaacataccgacgattatgatgaagtttcttcttatttagaattgaacgtcgattatttgccttctatggatatttttgatcgtatttgggaacagtatgtggaggataataaataagagagagtggagtggaaacttcctctctttttacactagaggctaaaaaattaatggacagaaaggtgtctttctatgaaaaatgtttcttttcaccgttatgtgatctcactgatttgtgtcgcgatcctctcgggaggcggtgtctacatttggcaaaaaagtacggctgcaacacaatccccacagaatcagcccacagtggcgacatcaaatgaactggaaaaagttcaaacgctttttgaccaaattcgtgccaattattaccaagaagtagatgaggatgtcttggtcgaaggggcattaaaaggaatgaccgatgcattaggtgatccttatacaacgtatcttagtgaatcagcagccaatgaattggatcagtctttatcaagcagttttgaaggaattggcgccacccttacccttgtcaacgactatccagaagtggcacaagcccctatcaagaactccccagctgagaaaaacggtttgcgtctaaacgatcgtattttgaaagtggatgggaaagaaacgaaaggcctgtcattaacagaggtcgtaaacaacattcgtggcaaaaaagggaccacagtcaagttgacgatccaacgggaaaaagagacctttgacgtatcgattacacgagatacgattccagtggatactgttcatacagaccttgatagtgagaaaaaaatcgggaaaatcgaaattacgacttttggtgaaagtactgcctccgaattaaaagaaggaattgagtcactgagaaagaaaggagcaaaatcatttattctggatgtccggcaaaatcctggtggacttttagatcaagtacagatcatggctagcatgtttttagaagatggaaaaacgatcgttaagtttgcagatgatagtggtgtcataagtgaaacgaaggcaagtgctgctcttgatgaaggattcaaagtcacagaaccggttgtcgtcttggttgatggcggcagtgcatcggccgcagaaatttttgcagctgcgttgcaagaatccgcagatataccagttgttggtacagaaacctttggtaaaggaactgtacaaaatgtaaaagaattaggagacaatagtgagttaaagatgacggtcatgaagtggctgacgccaaatgaagaatgggtcaatgagcaaggtgtaatgccagatcatcaagcagattttcctgagtatgcctatttagctccattaccaagagacaaagaattgaaagaagggcaaagctcagaagcagttgatcggttgaatcagtttctttctgcactaggttatcggaccaccggagatacatttgaccaaaccaccgtatcagccgttcaagccgttcagcaaaaagctgagctggaagtgacagggaaagtgaatgccgaaacagcacaagcaattgagaaagctgtgacggatcaattaaaacaagaagatcatgcttatttgaaagctgtcgagttattatcaaagtagtaacaaagtaaaagaggagggacatcatgcagcgaagaaaaatctggatcgatcgcttttggttcatcattaaatacgcgattattgcattggcctctgcattcctgattcgtgcattcttgctgatccctgtaccggtgggcggaaattcaatggaaggtaccttaagacagggtgatatggttttgatcgagaaaatctcacccatcaagcgatttgatgtcgtcgtttttcaaatgccggatggttccacctatattaagcgagtgattggattgcctggtgaatccattcgttacgaaaatgatcaactatatgttaatgatcagccggtagatgagaatttcctagtgaaaaatcgaaagaatgatcacgaaaatgtctcttatacgaatgactttgatctacagtcattgttgggcgttgaaaagctggggaaagacagctatttcgtgataggtgacaatcgtcgtgcctctaaagacagccgatcatttggtgccatttctggagatgcgattttaggaaatgctcgttttgtttattacccactaacccatatgcgctttatataatgaaaaacaaaaacatcatttattcatatttttgcgtaggtatcgctactttcaaaaaatatgagtagatgatgtttttaatagcagctagtatttttctgcagaaatcaatgttgttggatcctttgcttgataataaaatgctgttcttgtgtcatgttctttacataattatttaacacttactttgttgtttttcgttattctattgaaacgaacaagcaagaaataattttataagtaagcgttgacagtgccattttaagctgatatactttggctgtaagttagaaaaaggaacgagaaatagcgccgcagctgtttcttgagttatgttactgagacgatcaggcagaactcagaatatatatcaagtacactttcttttgtaaagtttatttgatatttattctgagttcttttttctggaaaggagaaacgaatgaaagttaaaaagattatcaataataatgttgccttagtggatagaggagggcatgagtcgatcatctacttaacaggagtcgcattcaagaaaaaagttggccaacatatttctgactctgaagtagaaaagacctttgtcttagatagccaagatcgattagagcattttagctacctcttatctcgcgccgatgatcaattgatcctgcttgtaaacgagctcgtacaatatggagaaaaagaaatcggcaaaagtgccaatgattatctttatttagctttgttagatcatttatcctttgcattgaaacgggcaaaaaaagatcaatatttgaggagtccattgacttgggaggtaaaaaaattctatcccagttattacaaaattgggttagaagccttggaaaggatcaatcaaacctttcaagtcgattttcctgaagatgaagccgttgccattgccttacattttgttaacttgcaggaaacgaaagcaaagtttgatgaacaattagctgatatggaaacgttgcgggatatgctgaatattatcaaatatcattttacgattactttagatgaaaacagcatgaattatatgcgtcttgtgacccatctccagtatttcatcgaacgattgcggaacaaccagacctattccgacaatgagtctcaactttataaacaagtgaaagcaatgtatccggaagcatttgccgcggttgaaaaaattgagatctatgtcaaaggaaagttcaacagttacctgacacaagaagagtacacctacttaatgatccacatcaatcgtgtaacagaaagaggagaatgacatgaatcaataccatgatttcaacgagcaaatcatcaaattagttggcggaaaagccaatattcaagctgttgtgcactgcatgactcgtcttcgttttactttaaaagatcgctcaaaagcagatacaaaaaaattgcaagagctggaaggggttattgatgtggtaagcaataatgttgcttatcaaattatcgtaggaacccatgtaaacgatgtttacaaagatttaattgaccaactgggaatgtcaggagacgaagcagaccagtcaaaaacgaagaaaaatccgatcaaggcgatgctagatgtgatttcggaatcaatgaatcccattttagaaccaatcatctgtgcaggtttattagccgcatttctttcaattatttcattaaccggtttgatttcgacagatagctcaacgtatcaaatttttgatgcattacggtcggctgttttttatttcttacctattttaatggcgatgagctgtgccaaacgattaggcgccagcccttatctagcagtggctttagcagcaaccattttatctgaaccgatcaacaatgtttcaggattgagtttatttggtattgggttaccacagatcacttattcaaatagctttatcccgattttattagcagtatggttcatgggctatgtaacaaagtttgccaaaaaagtcattcctaaaagtttgcagtactttatgtctcctttagtgatcatgctgattactttgccagccacactcctggtttttggtccattagggttttatattggggaaggcatcattggcttcttcaatctattgatggacacgataggtagctggtttgtgatgatgctctattctgcattacagccattcatcattatgttaggcgccggcaatttcattatgcctgttgtggcttcattgattgcagcgaatggatatgatccagcgtttatctcatcatgtacaatctctgacatcgctgtcggcggagcaatgcttggatacttcttgcgtgctcgcaacttgaaacaaaaacaactatttgggaccgtgactttatccgccattttaggagttaccgaaccagccatctatggtgtattcgttaaattccgtcgtccgtttattgctgtgatgatcggtggaggtttagggggactgttcgccggtttaacaggtgtcaaagcttattcaattgcttggggattatttggattacctgcctatattggcgaaggcgacttcatgaatctttggttaatggtggcagcggttgcgatcagttttattggtgcgactatcgcagcctatatgttagggattccagtagaaagtgatgaagtaccggcggttaaagagaaagaacaacctgtatcttctgaaatgattcgttctactgctttaaaaagtgtagtggaaggagaagtggttcctctcaatgaaatcaatgaccaagctttttcaactggtgctttagggaaaggaatcggtatcaaacctataagtcatgtgattcattcgccaatcgatggggaagtgctaacagtctttcctaccaaacacgcgattggtcttcgcagtgaccaaggcgttgaggtcttgatccatattggtatcgacactgtttcgttagaaggcaagtattttacgatgaatgtgaagcaaggtgatcgtgtgaggacaggacaaccaatcggtgaagtagattttgaaaaagttcgtgaagccgggtatgatccaacgactattgtggtcattacgaatacgaatgattttcttgatgtgatcccaacatccaataaccagttggtaaagtcggatgatttactaaatattgtcttgcaatagaaaccgtaataaagaagatagaaaaggtgagcagatgaagttaagaaatgattttttatggggcggcagcattgccgctcatcaatgtgaaggtgcttggcaggaagatggcaaaggcccagctattatggactatgtcacagtaggcagctatgaacagcctcgtgagatcgataaagaacttcttgctaacaaggtttatccttctcatacaggcatcgatttttatcatcgttatcaagaagatattgctttgtttgcagaaatgggattcaaggcattacggatttctattgattggtcaagaatttatcctaaaggggacgaagcagaaccaaatcaagccggtatcgatttttatcagcgagtcgttgacacgctattaaaacatggtatcgaaccgatcattacgctctatcacttcgaaatgccgattcatctagtgacagaatatggttcatggacaaatcgcaaagtcgttgatttctatttgcgcttttgtcacacgatgtttgaagcattcaaaggaaaagtcagatactgggccacttttaatgagatgaaccatatcgattctcaaagtgaggctagtgatatctttacctatatcattgccggattaaagtactctgaaatcgatgctaaggcccagacattagccatgattggctacaatatgacgcttgcaagttgtgctgctgtcaaaatgggacatgaaattgatgaaaacttccaaattggctgtgtttttggtatcgagccagtctatccagcaaattgtgatcccgtcaatgttctaaatgcctataaacaaatggatcgtgacttctatcagatcgatgcaatgtgcaatggtctgtttccccaatacaaactggaagaatatgcagatcaaggcataaaaatcgtgatctctgagtcagataaaaaagtgtttgctgagggcaaaattgattttattggcatgaattactatgcgtcttctgtcgcagaatatgaaggtgcatcggaaggaaaaagtgctttatttggcggtctgcaaaatccttatttggaaagcagtaagtggggatggacgattgatccgattggcatgcggtatttgttaaattacacttatcgaaaatacggattaccaatcatgattactgaaaacggactaggtgcagtggatgaaatcgcagaagatgggcatgttcacgatgcgtatcgcattgattacttgcacagacatgtcgagcaattgttgctgtcagttgaagaggatcaggtagactgtatcggttatctaacgtgggcgccgatcgatttagtcagtgctacgacaggtgagatgaaaaaacgctatggatttatctatgtcgacaaacaagatgatggaacagggtcttatatgcgtaagaaaaaagattcctttgagtggtatcggcaagtcattaactccaacggtgagagtatcaaaagggagaatcatgagtaaaaattagttttctattcatttcatttgtattttttttcatcaaaacttgtatcgatacgcactttaataagaaatgatggcgatctagaaagaagtaaattctttctagatttttttgttttcattgttttcataaatcagtatgagcgatgggaacctcttggtttcaaaaaggtttgatcttttcgattttgttgatcttagtacttagctacgatacatagctgcatttcgttttatttctattacttatatattcaaacgaggtagccgcttgcttgagcaaatgtgaaaaaaatgttctagaaataacgataaaattttttacagtgttgtaattctgtcagacttttggcattttttcttcaaaattgataagatgatttgagtaaaagacgtaaaatgaagtataattttaactaggctgaaaattggtctttttctcaaaaaaagttggcttcctacatcctgacactcagctagctacttttagctactttttcctaattttagctactttcacaagccagcaagttctcttggactgacactgagtgacagaatgaattgagccgtggaccaactcccctcatggtatttttaaattagtctgccaagtgattctagtgaatgaattaacaaggaaaggctgtggaatcagccaaataatggcatataacagaatagtcagcgtagttgggcagtttttggccattctttggatatttgctggactgtaagagcaggttgaatgagcaaatcaccactacaatacgcgtctcataggtatagttgcaggtgattggcaggtagtatttccaattaaaccaattcgtgttaaaatgcgtaggatactcggcaatcaggaaattttctcgattcgtccgatacttttaagagaaagccaaaacaatgtctgaaaaagactggtatgaaaggaaattaattatgagtaccattcaatggtttccaggccacatggccaaagcaaaacgtgaagtaagcgaaaaactaaaatttgtcgacatcgtgtttgaacttgtagatgctcgtctccccgtttcttcaagaaaccccatgctggatcaaattttacaacaaaagccacgcttgatcttgatcaataaagcagacttggctgaccctcagcaaacaaaactctgggaaggctattttagaaaacaaggtttcttagccatggcgatcaatgctcaggatagtcaaggaatcaaaatgatcgttcctaaagcaaaggaagttctgcaagaaaaaattgctcgtgacaaagctcgtgggctcaaaccacgtccgataagagcaatggtcattgggattcctaatgtaggaaaatcaacattgatgaatcgcttagtcggcaaaaaaattgctcagactgggaataaaccaggtgttaccaaagggcaacaatggttgcgttttggtacagaattggaattgctggatacaccaggaattctctggcctaaatttgaagatcctgagattggcaaaaaattagctttgactggcgctatcaaagatcaactcatccatttagatgatattgctttgtttgggttagacttttttgctcgctactatgaaggaagaattgctcagcgttattcactttctgcggaagaagaacaatgtctagcaccagaactattgatgaagatcactgaaaaacgtggctacaaagacaattatgatcgcggtagtgaattagtcgtttttgatattcgacaagggaagctgggaaggtacacattagatcgttacgaggagttaggtgaaaaagatgaaagagccgattaaaactatcaaagagcgactatttgccgaggaggttgatccggcttatgtggctcaactgatggcagacgaacgctctggtgtccaaaagctgattaccaagtatcaaaatcagcagcgtaaacagcgacaaatgcaagaaaaatatgcagaaatgtctgtatttgaacaagaactctatcagaaagggcttcggtttgttgccggtttagatgaagtcggccggggaccgttagctgggcctgtagttgccgcggcagtggttttaccgaagaattgcgggatcattggcttgaatgattcgaaacaactttctgcgaaaaaaagagaagaattatttattgagatccaaaataaagcggtagcgattggcatcggtattgcagatcatgaggaaattgatcgtgtgaacatttatcaagccagtaagaatgcgatgaaacgagcgctagctgacttatcgattacaccagagcatttattggtggacgctatgacgcttgataccgatattcctcagaccagtctgatcaaaggggatgcgcggtcgatcactatcgctgctgcaagtatcatggctaaggtatttcgggataatttaatgaaagattatcatggtgtttttcctcattatggatttgatcaaaatgctggttacggtacgaaaacccatttagaaggattagctgcccatgggatttgtcctatccatcgcaaaacgtttgcaccagtaaaacagtatgtaaaataattcatcaaacagcctcatttttacgaatcttattagtgagattctttagaaatgaggttgttttatgtactatcaggaatgtacgcccttcgataaaatcctccttcgcttgtcatttgtacaaggagtcggtattcaaagtcagtggcaggtggtcaaaggctgcctcgcacaagaaaattggactataacggctgaagaagttattcaaatgacagggatcacacgcaatattcttcgttttcaacagtcgtggcatcagttgacagagagtgacttagcggaaaaaatggccgaccagtcatttatcacctttttttcaaaagactacccacctgcactgagaaaaatcgctgatccaccattgatcctcttttacgaaggaaatctgtcattactccaaaagccttcactggctgttgtcggtgctagacaagcgacaagctacggtcagcagatttgtagaaaaatcattccggaactagtgaaaaagaagtacttgatcattagcggccttgcccagggattagatagtttcgcccatgaagcagcgattgaaagtggtggacaaaccattgcagttataggaacgggactggatcagtgttatcctaagagttcgcaacgtctttattctcagatcaagcaggaacatttgctggttagtgaatattcgcgaggaacattgccgcataaacatcattttcccatgcggaatcgactgattgcgggaatcgcacaggcagtttgtgtgattgaagccaaagaaaagagtggctctttgattactgcacagttggctttagaaaatgggaaggatgtatttgccgtgcctggagaagctttgaccgatcgatcagaggggtgtcatcagttgattcaagatggagcaaaatgcacgctgacagcagaagatatcttagaagaattgccttaggcttttgaacttatgatgatcctttcttgacaaaactttttctgaaagctatgataagctacgatttggatgtttggaaagcaagtggattgtttgccgaatatattatagtaggaaaaaatgaaggaaggagccattttttatatggcatataaatatctagtgatcgtggagtcgccagcaaaggcgaaaaccattgaaaaatacctcgggcgcaactataaagttgttgcgagtgttggacatattcgtgatttgccgaaaagcaaaatgggcattgacgtcgaaaatgactatgaacctcattacatctcgattcgcggcaaaggcgatgtcatcaagagccttcgttctgcagctaaaaaagcagaaaaagtttatctcgcaagtgacccggatagagaaggggaagctattgcttggcatttagctttcttgctaggactagatttaaaagaaaagaaccgggtcgtttttaatgaaatcacaaaagatgcagttaaagctgcgttcaaagaacctcgtacgattgatgtcgatttagtagatgcgcagcaagctcgtcgggtattggaccgtctggtaggttattcaattagtccaattttatggcgcaaagtcaaaaaaggattgagtgcgggccgtgttcagtcagtagcattgaaaatcatcattgatcgcgaaaaagaaatccgcgagtttatacctgaagaatactggagtatcgatggcaactttaaaaaagcaacaaaaaagttcaaggcgactttctgggggctagatggtaaaaagaaaaaactaccaaacgctgaaagcatcaaagaagtgaccgatcgtttagatggcaaagattaccaagtgaccaaggtagaaaagaaagaacgaaagcgcaatccttcggctccttttacaaccagtagtcttcaacaagaggcagcccgcaaactgaatttccgtacacgtaaaacaatgatggtagcccaacagctttatgaaggaatcccattaggcaagcaaggaacggtggggttgatcacctatatgcgtaccgattctacacggatcgcggatacagctaaaggagaagcggcggaattcatcgaaacaacctatggctcagctttttcagctcatggtggcaagaaaatcaagaatgcgcaaggggcgcaagatgcccacgaggctgtacgtcctacaagcgtcatgcgtacaccagaagaaatggaaaagtacttggacaaagatcagttgaaactctatcgcttgatttggtctcgttttgtagccagccaaatgacccctgcgattttggatacaatgaaagtgacgctacagcagaatggcgtcatattcatagctaacggatccaaaatcaaatttaaaggattcatgcaagtgtatgttgagggacgagatgacggcaaagaagacaaagagaatattttgccggaattaaacgaaggggacgttgttcagtcgatctctatcgaaccaaaacaacacttcacacaaccacctgctcgttttagcgaagcaacgttgatcaaaactttagaagaaaatggtgtagggcgtccatcgacttatgcaccaactttagaaacgatccagcggcgctattacgttaaattaactcaaaaacgttttgaaccaactgaattgggagaaatcgttaattcgttgattgaggaattcttccctcaaatcgtcgatacccatttcacagccgagatggaaagcagcttagacagtattgaagcgggcaaacaagaatggatcaaagtcgtggaccaattctatcgaccatttgaaaaagaattatccaatgcggaagaaaatattgagaaaatccagataaaagatgaacccgctggcttcgattgcgatatttgcggtcatccaatggtcatcaagctaggtcgttatggaaaattttatgcttgtagcaattttccagattgtcgaaatacaaaaccgatcgtcaaagaaatcggagtggaatgtccagtttgtcaccaaggacaagttgttgaaagaaaatccaagaagaaccgaattttctttggctgcacacgctatccagaatgtgactttacgtcatgggataaaccagtaggcagaaactgtccaaaatgtgacaactatttggttgaaaagaaagtcaaaggcggcaagcaagtcgtttgtatcaaaggtgattatgaggaagatgttcaaaagtaggctatcgatcgtttttgacctctcaataaaaaaatgaagtgagcgcaagaagtatctgctgagagacagcagacttctgcgttccttttcaaaaaacagagctgtgacacaaggaatagaataaaaaatatgcagagacaaacggtgatctgaagatcagcatctgccaatgtaagggttattttttgttttgatgacttttggcacagactcttttactataaaggagacgaagtatgaaaaaaatcaatgtaattggtgctggattagcaggaagcgaagctgcttggcaagctgctgaggcaggagtggctgtcaatttgtatgaaatgcgtcctaagaaaacgacagaagcccatcatacgaataattttgcggaacttgtttgtacaaattctcttagaggaaacaatttaaccaatgcagtaggtgttttgaaagaagaaatgcgccgcttgaattcggttattatctcttcggccgatcagacagcggttccggctggtggtgcactagccgttgatcgggacgatttttctgaattagttacaaagcgggtgaaagaacatccgttggtaacagtgatcgaagaagagatcaccgaaatcccagaaggaattacggtaatcgctactggaccattgacttcagaaccgttatccaaggcgattcaagcattcaatgggtcggaaggcttctatttctatgatgccgcagcgccaatcattgataaatcaactattgatatggataaagtttacttgaaatcgcgatacgacaaaggagaagcagcatacctgaattgtccgatgaacgaagaagaattttatgcctttcgtgaagccttggtaaatgccgaagtcgctcctttgaaagagtttgaaaaagagaaattctttgaaggctgtatgccaattgaagtgatggcctctcgtggtccaaagacgatgttgtttggaccaatgaaacctgttggtttggaagatcctaagacaggcaaacggccttatgcagtgatccaattgcgtcaagataacgctgctgcctcgttgtacaacattgtaggtttccaaacgcatctaaaatggggagaacaaaaacgggtctttcggatgatccctggattagagcaagctgaatttgtccgctatggtgtaatgcatcggaatagtttcatgaactcgccagaacttctgcaacaaacctatcaatctcgcaaacgtgatgacttgttttttgctggtcaaatgacaggagtagaagggtatgttgaaagtgcggctagcggtctagtagctggaatcaatgcagcaaaacttgcaaaaggggaagaaccaatcatctttccgcaggaaacaacaatcggcagcatggcgtattacattacgcatgcagaaggcaaacatttccaaccaatgaatgccaattttggcttgcttcctgaactgcccgaacgaatcaaagataaaaaatcccgttatgaggcattggctaatcgtgcgcttacagctttagaggctgccaaagaaacagttgcaaattaattgtcgaaaactttctcacgagaaattgttgagaaagttttttttgaattgtcttgaaacttggtagcggttatcatatgattaacagtaacaatagcgaaggtggtgacgatcgtgattggggaatgggtcacattgcttcaagagtatctgcagcagtttccatcttatattcaaatagtgggctggctgattgtactatttgttttgatatttgccgtttttctgcttttcagtttgttgctaggcccgtttatgtggcttttcaatcgcttgacagataaaaatcgtagcaatgttcttggtcatgaagattttttgattggtgaattgacagaaaagatcgtcggaaataccctcggtgaagtgatggagattggcagtaagacagcgcgttctgtttatccggcaaagttctataaagaagaggatattcgagaaaagcgagaattaccagtcggaaccaaagtgattattgttgattttgacaaaaaaggtattgctttagtggtagaaaaccacaattttattgaatagggagtgttggaaaatgttagatacagggaatgcattagattttttaagtaatccaattttatggatcatcgttttagtcgtgttattgatcgcatttttaatgattcgttaccgaatcggcaagccagatgaagcgttgatcgtaacggggtcatttttaggtaaagaaggcatcaagattttaaaaaatagcggaacattcgtgatcccaattgttcaaaaagcacataaattgagtttactgacgcataaacttgaaattggcacaccagaagtttataccgaacaaggggtaccgatcaaagcaagtgcgacggttttagttaaagttggtaacagtacggaatcgatcaaaacagctgcagaacaatacttaggcaaatcaaccggcgagttggaagatgaagcacaagaagtactggaaggccacttgcgggcgattctagggacaatgaccgttgaagcaatttacaaaaatcgagatgattttgcggaacaagtgcaagaagtcgcatctaccgacttgaaaaaaatgggattagagatcgtttcatttacaatcaaagatgttagtgacagtaacggctacttagatgccttaggacgaccgcagattgctgaagtgaagaagaatgcagaagttgcagaatcaaatgcattaagagaaacacgaatcaagcaagccgaaaatgaacagttggcacagcacgaggaaattcgtcgccaaacggaaatcgcagaagcaacgaaagatatggcattgaaacaagcacaatacaaacaagaacgggaagtagcagatgctaaagcagaacagattgctgtgggcgaaaaaatgaaagtccaattgatcgaacaagaaaagaacatcgagatccaagaaaagcaagctgaactgacggaaaaagaattgaatgctacagtccgtaaaaaagcagaagccgataaatatgttgtagaacaaaatgccttggcagataaagcaagagaaattgctcgtgcccaagcagaggctgaaaaagtgaaactagctgcccaagcagaagcagagagaatcgaaaaactcggttcggcagatgctgaaagaatcgctaaagtcggtcaagcagaagccgaaagtcgcgaaaaaatggcgattgctttaactaaactgaatgaagcaggtattttgatggaattcatcaaagtattacctgaaattgccaaagaagttaatgcgccacttagcaacatcgataaagtggtcagctttggaggcaacgacggactccacgacatgggagaagccggcttggcacggacatttgatactatcaaagaaacaactggcctcgatttagtcaatctcattaatcaaaccatgtctactaaacaaggaaacaaagagttagtagcagccatcgaaagccaaaagccagtagaaaatcaatcaaacacagacaatgacacccaaccaatcgaataacccaaacaacgcactcaaacgagtgcgtttttgctgcgaatcacaacgagtggcttgcgaagcaaggcagagttgatgatgagcagcggggagcaaagcgagggtagcaaccttgaaagaattttctacggctgactctggaaagagtggaacgcaagttctacttagttcacagtgagaagctactggaggcaaagcatatgccaagttgaatttggggcaagtccttcgcaagttttcgtgtaaatcataacaatcaaaaaaagcttcgagaaacctgcggatcttttctaaattctcccttaaagaattttcataattatgtctaaactttgaaatattggttaaattctgacaattcgtttgttttttttaaaactctatgatacagttatttcgagtcatgaaatgggggattagtttgccggagaacgaacttcaaaatgatttttttcgttatctaattgttgaacgaggctattctgataagaccaagtctgcttaccaagaagacatggaggatttctttcgttttttaaaagagtctggcaatgaagactttcttgccattgatcaccgtgacgtcagagtataccttagttttttgaatgagcgcaattacagtcgcaattcgatcagccgtaaaatggccagtttgcggtcgttctatcactttttaacgaaacacgaagtcattaaagaaaatccattcgcttatattcacttaaagaaaaagaacgcaaaattaccgcgttttttttatgaaaaagaaatggaagcactttttgaaagtgtaaaagggcacgaacctttgcagcaacgaaatcgagctttgttggagatcctgtatggatccggactgcgggtcagcgaatgcagcaacctaaccttgtcagacgttgattgggagaatggtgtattgttgatccatgggaaaggaaacaaggatcgttatgttccttttggcagctatgcgcaagaagcgttgcgagactatgtctcagctggacgccaacagttgatggagaaacaccacaaacggcatgagattgttttcgtcaatcatttaggtgacggaatcacagcgacggggattgagtatgtgttgaatcaaatcattcgcaaaagtagtttggacagcaagatccacccccacatgttgaggcacacatttgccactcacttattaaatcacggggctgatatgcggaccgttcaagaattgttaggccatgccaacttatctacgacgcagatctatgcccatgtcacaaaagatagcttgcaaaaaaattaccgccaatttcatccaagagcttaaaaattggcgacaggaggaaagaattatgaaatcaccttttcattcaacaacgatttgtgctgttgaaaaagatggcaaattcgcaatggccggagatggtcaagtaacaatgggagaacaagtcgtcatgaaggggacggcacgcaaagtacgccgaatctataacggtgaagtcgtagttggatttgctggaagtgtggcagatgctttcacactggaagaaaaatttgaaggaaaactcaatgaatacaacggcaacttacaacgtgctgctgttgagttagcgcaagaatggcggacacagcaatcgatgcagaaactagaagcaatgctgatcgtgatgaatcaggaagaaatgctcttggtttctgggacaggagaagtcatttcaccagatgaagggattttggctatcggttctggcggcaattatgcactcgctgcagccagagcgatgaaacgttacggcggtgatctttctgcaaaagaaattgctgaaggagcattgaatatcgccgctgatatttgtgtctttaccaatcacaacattattgttgaagagttttaaagagggatgaagctatgacaaatcaaaatatatcaccaaaagaaatcgtcaaagaattagatcaatacattgttggccaaactagtgccaagaaatctgttgcagtagctttacgtaatcgctaccgtcgtctccagttggatgagaaaatgcagcaagatgtgacgccgaagaatattttaatgatcggaccgactggtgtcggaaaaacagaaattgctcgtcgattagcgaagatcgttgatgcgcctttcgttaaattagaagcaactaagttcaccgaagtcggttatgtcggacgtgacgtggaatcaatgattcgggatcttgtggaaaatgccatccagatcgtaaaaaaagagcaatacaaaaacgttcggctgcaggcagaaaagaaagccaatcgtcgactggttaaagtactggtacctggaatcaaaaaagagcaaaagaaatctgcgaatccatatgaacaaatgatgaatatgttcaatcctggccagcaggcagaagaaccaaaagaagaactgacggacgaaatccgcagcaaccgtcaagccatttatgagcaattagaaaaaggcttattggacaatcgtgaagtaacgatccaggtggatgaaccaaaaacacaggcaccaatgatgaacaatggattggaacaaatggggatcgatttgaatgaaacattaggtgcattgaaaccgcaaaagaaaatcgaacggacagtaacggtaaaagaagctcgagaattattgatccaagaggaatcttcaaaattagtgaatgatgcggatatccatagtgcggcattgcgtttagccgaatctagcgggatcatcttccttgatgaaatcgataagatcacatcaaaatcgcaacaatcaggcgaagtttctcgtgaaggtgtgcaacgggatattttaccgatcgtagaaggatcacaagtcaacacgaaatacggccctttacaaaccgaccatatcctattcattgcttcaggtgcctttcatttgtcaaaaccaagtgatttgatccctgaattacaaggacgcttcccgattcgtgtagaacttgatgatttaacgaaagaagactttgtcaagatcctgacggagccaaacaatgctttgatcaagcagtatattgccttgttgggaacagagaatgtgacagtcacttttacgctggaagcaatccaaaaaattgcggaaattgcctttcaagtgaatcgcgatacagataacattggcgcccgtcgcttacacacaattctagaaaagttacttgaagacttattgtttgaagcatccgacatgcaaatgggagaaatcactattacagaagcgtacgttgaagacaaacttgcttctattgccaaagatgaagacctaagccggtatattttataaagggagagaaccaatgaaaacacttttagaaaagacacgacaaatcaatgaattactgcaacaaaaaaataccttcaatctggcatctgatttgccttatgataaaatggcggttattttaggtgacatactcgatagcaatgcttatattatcagtagtgacggtagtgtgttgggattcgttgagacgcatgatgtcaacaatgaacgtatcaaaaagatgtttgtagaaaaacagtttcctaaaaattatacaagtttagtagataatttatcttcgacagaagcaaatgttcccatcagcaacgatatgactgcttttcctattgagatgcgggagttatatccgaatggtttaacaacaatcgtgcccatttatggtgcaggcgaacggttgggcacgatcattttgtctcggatcgaaaaaacgttcgatgacgatgatctagtcttagcagaatacagtgcaactgtagttggcatgcagtttctttatcaaaaatcccgcaatatcgaagaagacgttcgtagtgcgactgccgtacaaatggcgatcaatacactgtcatacagcgaattgaaagctgtccaagcgatttttgaagcattagaaggggatgaaggacgtttgaccgcttctagtattgcggatcgaatcggtattacacgttctgttattgtaaatgcattgcgcaaactggaatcagcaggtattattgagtcacgttccttgggaatgaaaggaacttatttaaaagtgttgaatagtcgtttcaaagaggaattgaacaaacatcaatattaggagatggcgatatgacagttacgatcagcgcagggcatttgcaggcaacaattgccgaaaaaggagccgaactgcaaagtttgattgatgtgaataccaacttagaatatatttggcaagctgatcctgcacattggggaaagcatgcaccaatcttatttccgatagtgggtgcgttgaaggacaatcaataccgctacaaaggtgaaacgtatcatctgccacggcatggttttgctcgagacatgatgtttgaagtcgtggagcacaaagtagattatgttcgtttactactagctagcagtgaggagacaaagagcaactatccctttgattttcagttgtttgttagttacgaattaggtggagacggtcttgtagtcaagtatcaagtcgtaaatgatagtcaggaagacatgttcttctctatcggtggtcatcctgcattcaatgtaccgttaggagaggataatgtatttgaagatttttatctcacattctcacctaagaaatctcgtgtaaaattgccgttggtaggcaattatatcgatctggagcagcggacattgggacaaacgaacactgatctacggttgactcatgagatgtttaagaacgatgccttgatttatgaaacgaaagggttgaattcattttcgatccgcagtgaaaaatctcctcacagtgtgacattgagctataataatatgccttacgttggcttttggacgacttatccagtagaatctccttttttatgtattgagccatgggtaggtattgcagataccttagagactagtggcgaactacatgaaaaaacaggaatccaatgcttggcagccaacgagcaatttgaaacgaaatattcgatcacagttaagtaagcctatgtgaataagaaaaaaagaagctgggacgaaagtcatgaatgacttttcccagcttctcctattcttttttattaagaccaaaagagatacggctctctgtgccgtctttgatccgcttgatattttcacgatgacggataaaaataaaacaggtgacaccaattgcgatacacgtcaataaccaattttgttttggtaaaatcattggtgcgacataaggcaataggattgtcgacaaagtgatcaagcaggctgcaatcatacttgtcaggctgaccatgctggttatgaacaaacaaaccacaaaaataagcgctgaataaatgaagaaaattggattgtagcctaaaagcatgcctgcgctggtcgccaccgctttcccgcctttgaacttggcaaaaattggaaacgtgtgacctagaatagcacaaacaccaaaccaaagaggattgattgttgtgactgaaaagatcgccggcaaacaagtagccaaggtacctttcagaatatccatcaataaaacaatgacgccagctgatttgccaagaacacgaaaggtattcgtagttcctgtattcccgctgccaaattggcgaatgtcttttttgaagaatagctgaccgatccagacaccagagggaatcgaaccgagcaaataagcaataaatagtaacagaatcgtcttcatgataacccactttccttgaaagtctagagcaattttagcatgaaaccgtcgcagcaacaataagaaaatactgaagctatggataaacgagcaatgatagatggatcatccaaaagctaaaagtgactttgccttgtcgaacggtaggaaaaaggataagatagtttagaaaaatgttcgcttgaaaaaagccgattttatgttaagattttttttgcgaatcattcatgttgggtttccgcggaaacccacttaatttagttaaaggagcggtggctttggcaaagaaaaccacagagtataatgatgcctcgatacaagtcctagaaggcttggaggcagtgagaaagcgacctggtatgtatatcggatcgactgacggccgaggcttgcaccatttggtctacgaaatcgttgataatgcggtcgacgaagcactatcaggattcgggaatgaaattgatgtcactatccacaaagacaatagtatcagtgtgcgagacaatggtcgtggaatgccggtaggaatgcatgcttcaggaatcccaacagtcgaagtcatctttactgtactgcatgctggcggcaaatttggccaagggggctataagacatcaggtggactccacggagtgggtgccagtgttgtaaatgcgctatcaagctggctagaagtttctatcgtacgagatggtatcgaataccaagagaaattcaaagatggtggcaaacctgacggtacattgaaaaaaatcggaaagacgcggaaagcaactggaacaaccgtacgtttcaagccggatgacacgatttttacaacaacgaaattttcttatgacacgttagcagaacgattgcgagaatcagctttcttattaagaggagtgaaaatcaccctaacagatgagcgggctgaattgcagcaagaggtctttttatttgaagaaggaatcaaagagtttgttgattatttaaacgaagaaaaagatacattgacgcctgttgtgtatttttctggcacaaaagaagcaatcgaagtggaagttgctttccaatataatgatgggtattccgaaaatgtcctatcatttgtaaataacgtgcgcacgaaagacggcggtacccatgaagtgggaatgaagatctctatgactaaagctttcaatgaatatgctcgaaaggtcggcctgctgaaagaaaaggataaaaatctggaaggcagtgattttcgggaaggtttagcggcagttctgtcgattcgggtaccagagaatctgcttcaatttgaaggtcaaacaaaagaaaaactaggaacgccgatcgcacgaaatgcggtagacaatgtgattggtgaacaactgggttattacttgcaagaaaatagcgagatgagccaaatgcttgtccgtaaagccatcaaggctcgggaagcgcgggaagctgctcggaaagcacgagaagaaagccgcagtgggaaaaaacgcaaaaagggcgaatcgttgttatctggaaaattgacaccagcccagtctcgtaatccgaaaaaaaatgagttgtacttagtcgaaggagactcggctggtggatcagccaaacaaggccgagaccgtaagtttcaagcaattcttccgttacgtggaaaagtcatcaataccgagaaagccaaaatgcaagacattttgaaaaatgaagaaatcaatactatgatctacacgatcggcgcaggtgttggtccagaattttcgattgaagactgcaattatgacaaagtaatcatcatgaccgatgcggatacagatggtgcccatatccaagtcttgttgctgaccttcttttatcgctatatgaaaccattgatcgaagctggcaaagtttatattgcattgccgcctttgtacaaagtttcaaaaggcctaggcaaaaaagccgtagttgaatatgcctggacagatgacgaattaaacgcggtgaccaaaaaaattggtaaaggctatatgctgcaacggtacaaagggttaggtgagatgaatgcagatcaactttgggagacaacgatggacccagaaacaagaacattgatccgtgttcgaatcgatgatgcggcacaagcggaacgacgggttactacattgatgggtgataaagtagaaccgcggcggaagtggatcgaaagccatgtccaattcagcttggaagaagacggcagtattttagagaaaaaagaagagacgatccctggattggtcgaagaaaaattacaagaagctgagcaaatttcagcaatcagcttgtctgaggattaggaggggatctcttggaacataaaaacaatatacaagaattaacattagaagaagtgatgggggaccgtttcggcagatactctaaatatattatccaagaacgggcattaccggatattcgagatggcctaaagcccgttcagcgacgaattttgtttgccatgaatcaagatggaaatacttatgacaaaggatttcgtaagtccgcaaaatctgtagggaatatcatggggaattttcatccccatggagattccagtatttatgaagccatggtccgtatgagtcaagactggaaattaagacaaatcctgatcgaaatgcacgggaataacgggagtatggatggtgatccgccagcagctatgcgttatacagaagcccgtttgtctgaattaagcggagaattattgaaggatattgaaaaagataccgttgagttagtttggaattttgacgataccgaaaaggaaccaactgttttgccagcaaaatatcccaatctgctggtcaacgggtcgacagggatctctgccggttatgcaactgaaattcccacacacaatttaagtgaagtcattgacggaacgatttatttgattgatcacccgaacgcctcattggataaattgatggaattcattccaggtccagatttcccaactggcggcatcttacaaggaaaagaagaaatcaagaaggcatatgaaacaggtcgtgggaaagtgatcttacgttcaaagactagaatcgaagatatcaaaggcggcaaacagcaaattgtcatcaatgagattccttacgaagtcaataaagcgaatctggtcaaaaaaatggatgagattcgtttaaacaaaaaaatcgatgggattgccgaggtccgggacgaaacggaccgtaccggtttgcaaattgtggttgagctgaaaaaagatgccaatgctcaaggaattttgaactatctatttaaaaatacggaactgcaaatcaactacaatttcaacatggtagccatcgatgaaatgcggccgcagcaagtcgggttgaaacatatcttagaaagttatgtgaaacaccgtcgggaagtcattgctaagcggagccgctatgagctgaagaaagcgcagaaacgtcagcacatcgttgatgggttgatgaaggctctttcgatcctcgatgaagtgatcgcgacaatccgcagcagtaaagacaaaaaagatgcaaaaaataatctggtcgttcagcatgggtttacagaagaacaggcagaagccattgtaacattgcaattgtatcgcttgactaatacagatatcacgcaattacaggcagaagcccaagaattagctgaaacgattcgcgaattgacgaaaattttgaatgaagaaacggaattattaaaagtcatcaaaaaagagctaagagaaatcaagaagaaataccactctgatcggatgaccgagattgaagcagagatccaagaaatcaaaatcgagacccaagtacttgtcgcccaagaagatgttgtggtaactgttacgacagatggctatgtcaaacgcagcagcttgcggtcttatggcgcttctaagccagaagagttaggcatgaaagaaggcgatgcactgctttatagcgggcaagcaagcacattggatcatttgttgctggtgaccaataaagggaacgtcatttatcgccccattcatgagttgccggatctcaaatggaaagatctaggggaacatatttcgcaaacggtaatgaatctagcgaccgaagaaaccattttagctgtattcacctatcaagaacttgatccgcaaaagaatttcgtgctgattagcaaaaacggtatgattaaacaaacaagaatgacagaatttgaaccttggcgtacgtacaagagtcggccattgactatgatgaaactaaaagatgaggccgatgaacttgtcaacgtgtatttagcggatcaaaatgagccgttggatgtctttctagttagttatcgtgcttttggcctacgctatccattagccgaagtgcctgttgtaggaccaaaagctgctggagtcaaagcgatgaatcttaaagaagatgatcagatcgtcaatggattattggtttactcggaaggagatacgcctgtaatcatggtcactcagcgaggggcggtcaaacgaatgctggctcaagaaatcagtcagttaggacgagcgaaacgaggactgatggttctcagagagttaaagaaaaatcctcatcggattgtttatatgggaagcggtgaaaaccaatccctgattttgactactcaaaaggggcaaatgatcgagatcgagacgaatcaaatcccaatcaatgaccggacatcgaatgggtcctttgttaccgatgaaaaatccggcggcttgatccatgaagttgctcgagtgattgatcctgcgattcaagaagattctgtactataagttaaatgtaaaacacgcatctgtaccaatacagacgcgtgtttttttctatataattaatttttcacattttcaaaaaatggactttaataaaaaattcacatttaaaaaacgttgatttaaaagctgtttcgttgcgttttatgttttaatagctaattttgttaaaaataattcttgtaaatgcttgcaatgcaaacgctttgtgttatactattcacgtaaagctgttacacttagtgaacagaaaatttaaggaggtccatcaaatggaacaatggaatggatttaaaggaaaaacttggaaagaagaagttaacgtacgcgacttcatccaagaaaactacacaccttatgacggaacagacgaatttttagctggcccaactgaagcaactacaaagctttgggatcaagttatggacttgaacaagcaagaacgtgacgctggcggcgttttagacatggatactaaaatcgtttcaacgattacttctcacggcccgggctatttgaacaaagagttagaaacagttgtcgggttccaaacagacaaacctttcaaacgcagcttgcaaccgttcggcggtatccgaatgtcagaacaatcagcagaatcttatgggtatgaaattgattctgaagtttctcacatcttccgtgactaccgtaaaacacacaaccaaggtgtatttgatgcgtacactcctgaaatcagagctgcacgccgttctggtgttatcactggacttcctgatgcttatggtcgtggtcgtatcatcggtgactaccgtcgcgtagcattgtatggtgtggattacttgatcaaagaaaaacaacaagacttgttgtattgcggcaatggcacgatgtcagacgatatcattcgccaacgtgaagaattaagtgaacaaattcgcgcattaagcgaattgaaagaacttggtacaatctacgggtttgatatttctcaacctgcacaaactgcaagagaagcattccaatggttatatttaggctatctagcagccatcaaagaacaaaacggagcagcaatgtctctaggacgtacgtcaactttcttggatatctatgtagaacgcgaccttaaaaatggcgtgatcacagaagaagaagcacaagaaatcgttgaccatttcgtaatgaaacttcgtctagtgaaatttgctcgtacacctgaatacaatgcattattctctggtgacccaacatgggttacagaatcaatcgccgggatgggtgaagacggacgccacatggtaactaaaaacagcttccgtttcttgcacacactagcaaacttgggaccagctccagaaccaaacttgactgttttgtggtcaacacgcttgccacacaacttcaaaacattctgtgcgaaaatgtctatccaaacatcagcaatccaatatgaaaacgatgatgtaatgcgtggacattggggcgatgactatggaatcgcatgttgtgtatctgctatgcgcattggtaaacaaatgcaattcttcggtgctcgtgcgaacttggcgaaaacgttgttgtatgcaatcaatggcggggtcgacgaaaaatcaaaagcgcaagtgggacctaaattccaaccaatcacttcagaatatcttgattacaatgaagtaatggaaaaatatgacacaatgatggactggatttgtgatttgtatgtcaatacattgaacattatccactacatgcatgataaatattcttatgaacgaattgaaatggccttacaagatacagatatcttgcgtacgatggctactggtatcgcaggattctctgtagcagttgactcattatctgctatcaaatatgcgaaagtccgcacaattcgtgacgaaaacggcatcgttgaagattacgaaatcgaaggcgactatcctaaatatggaaacaacgatgatcgcgtagacgatattgctgttaacctattgaaaactttcatgaagaaagtaaaacgcacaaaaacttaccgtaactcaaaacatacaacatcgatcttaacgatcacttcaaacgtcgtttatggtaagaaaacagggaacactcctgacggacgccgcgctggtgcgccatttgccccaggtgcgaacccaatgcacggccgcgatacacacggtgcgttggctagtctttcatctgttgcgaaattgccatatgactattcattagatggtatttcaaatacattctcaatcgtacctaaagcattaggacgtgacgacgaaacacagcaagaaaacctagcaactatgttggatggttatgcagcaaaaggtggtcaccacttgaatatcaacgtattcaaccgcgacacattgcttgatgcacaagcgcatccagaaaaatacccacaattaacaattcgtgtatcaggttatgcagttaacttcatcaagttgacaaaagaacaacaagatgacgttatcgctcgtaccatgcacgaagcaatgtaatagcacaaaaaaaggcggcggatggaacattccgccgctattgttatgaatcactgcgactgtgaagcagagcagatgatgacaagcgtagtttgttcatcaaactattgcctcactgcgagtatgggcgaggaatcaatggaataaaacgatgcaactttatttttagtttcttcaagaaaggaagagcaacatgtcagtaacaggacatattcattcaacagaaagtttcggatcagtggacggaccaggtattcgctttattgtctttatgcaaggatgccggatgcgttgtgagttttgtcataatccagatacttggaaaatcggtgccggtatcgaacggacgacagatgacgtactggaagaagcactcaaatatcgagaattttggggagaaaaaggtgggctgactgttagtggcggagaaccattgcttcagttggacttcttgatcgatcttttccgaaaagccaaagctgcaggggtgaacaccaccttagatacgtgcggaaaaccttttactcgggaagaacctttttttagcaaatttcaagagttgatgactgtcactgatttactattatttgatatcaagcatattgataatgatgctcataagaagctgaccacacaatccaacgacaacatcttagaaatggcaaaatacctttcagaaatcaataagccagtctggatccgtcacgtgctggtgccattcagaagtgattatgatgagtttttgatccgtttagatgcgtttatcaagacgttgaataatgtagataaagtagagattttaccttatcacacaatgggtaaatataaatgggatgaattagggctgaagtatccactggaaggaattgagccgccaacacaagatcgcgtgaaaaatgcaaaagagttgcttcatgtcgatgactataaaggttatcttacccgttaacaagcgtagagaagataactattgattctttcctattttttgctatcattagaaagtggaaaatgaatgaattaggagcgatcattatgtcgaaaatattagtatttggacaccaaaatcctgatacagatgctattggagcagcaattgcttttgcgcacttgcaaaaggaattaggaaaagataccgaagcagttgctcttggaacaccaaacgaagaaacgcaatttgctttgtctcattttgaacttgaagccccgcgtgtgattgagcagattgaggctggttcagaagtgatgcttgtggatcataatgagtttcagcaaagtgcagaagggatagcagaagctgccattttagctgtagttgaccatcatcgtatcgccaattttgaaactgcaaaccctctctactaccgtgcagaaccggttggctgtacgagtacgatcgtgttgaaattataccgtgaggcaaatgtagagattccagcagctattgccggaatcatgttgtcagcgatcgtttcagatacattgttgttcaagtcacctacatgtactgaggaagatatcgccgctgcaaaagagttagcagcaattgctaatgtggatctagaggcgtatggcctggatatgctgaaagctggaacaaatttaacaactaaaacagctgctgaattgttggatctagatgcaaaaagttttccgatgggtggaaaaagcattcgtatcggtcaagtaaatacagtggatttgaatgaagtgtttagccgccaagaagagctagaaacagcaatgaaggccgaaaatcaggcaaaaggttatgacttgtacctactagtcgttactgatattttgaacagcaattctgaattgctagtgattggagagccaactgcaccagttgaagcggcgtttaacgttgttttgacagcaaatcgcgcattcttaccgggggttgtttctcgtaaaaaacaagttgtgccgcaattaactgaaagctttaataactaatagctgacaggataatacgggcaaaaaagatgaacatttgaattggtcggacaatcagcaactgcagtcctttcactgtaataatgaaaggtttttggctagcaggggagcttaagattgtccggctatttttgaatgagagacggccctcctagtgggaatggaaagagagcgaaagacatggaatttttttatagtagtcattatcaagggattcagaaaattattgattcagagttgttctcaaaactgattcttttcttgaaaaaacaacaaaaaccaccaatcttaagagaattaaaacaaaattttccagagaaaaattttgaaaaaatacttgatcagttgatcgatgctgggatcattacccgaaaggatcgtcgctatcaagtggcatttcctatctattccacaaaagatcagcagaagagtcgtgagcgttggcaacaacctaatacgataattttagaagagttggcgttcattttacaagcggacatcatgagtgatcagcgctttttctatgcttgtgaagaaggtgtggtacaagcattcatttatcggctaatccatgagtcttttcagcttatttctttttccaaagaaaaatggccagcaacgattcccgctttttttgcagcaaatcgacaacaactgtcattgccaatttatcaggagctgttgcatttgctaggggatgttgatgaggcctattacttagatcaaatcagtgtcatctttgaacgggtggcaaaacagcgaaaaatccggccaagtatttttctcacatcactcatagaaggaaatattcttcagtcagaacagcgttttgatcttcctattgttgaggctgcatttctcactgagcagaatgggtcattgatgaaaggattgtccgaatttgatcggcgtacattattagcagattatcttggaaaaacatctaatccacaaacaattctcattacggaaatgataaaattttaataaatgtttagaaatagaaaagataaaaaagaaagaattcgttaaaaccctctttgggataacgttttctttctttttttgcattttttattatttgaaaatgattagaaaataacgagcgtattaattgattgttctcatttgaggtggtatgataactttagaattttgaaagagggcgtaaaaattggaaggaatcaaagcatttcatacagaagtgattgaagaaacaagaagcaaagcagagatgatcacttttgtttcgatggcggaaattgagcatgcacgaaaagaactttgcgaagccggtattcaagaaagccgcttttctgatggagaattaatttttgcacttaaacaaaaaaatgaatgtcatgcaaatacaatcgtaccaatcgtgatcgactggttattaatgaaaaactatttattgactccggcccaagctgttcgttttttgacgaataaattaggacagacagaatcagtatctttgaaagcattaggagatcttgagtttgacggggatggaaaatactttttgattgcctgtcgatcaatgaataagcaatataaaaaagtgtataaagtatatacagatggacaagtgaaagaactttggcgggcatgatcctttttaggatcgagagaaaggtcatgcctgtctctgaatggattaatcaaaggttgtgagtctcaggtgaaatcaaatcaaagaatcgtctttgcaagtagccatgtgtttatttttattcttagtatggtgtcggcacttttatttattttaaaagttcctaacacatttaatgcaaatcaaattttttcagagaatatacatttttcagacacagtctttgatgtggtcacaaggctttttttattgggcatctgtagtttatatacaacagttgccagcttctggtcttttcgttcttggccttatctttcagccggaattgggatcgctgcggtcataacggctttccagatgaaagttcaattccatccatttttgtttgctttatttttgatcgtcggtttgtttcaagtaagtgtcgcttcttatgtcgcttttgtttccaaaaaaagaagcagcactgaaacaggttgaaccaatcgtgttcaagctgttttttttctgccttaaatcttttgattataagcagaggatcgaaatacaacgaatcaggaataggaattgttctattccggcaatcgccaaggcttttacgttacgagatctttaatttatgctattctacatataggagcagcaatgctaaattaaagccatctgccctgaactattttcccagtgatcttcctaatattctgtttttagatggaaggttgattggctgaaaaaatagggttgatttaagaggaggtttgacatacgagtggaaaatgagcaaatgattacagcagagaagcagtttacgaccggtgaaaatttttattcacagcatcttttaggtgcacatcgtatgaaagcaggctatgtttttcgtgtctgggcgccaaatgcgcaaaatgtctggctagtaggtgacttcaatcaatgggatgactctttgccgatgacgaaacgctccgaatcggggatttgggaaattaccaccaatcagcctcaagaaggacagcattataaattcaaggtcaagcaagccgacggccgtgaaatcatgaaaattgatccatatgcaatttatttcgaagaacgtcctggaacggctgctgtcttgtacaccgtgccggcaaaaaaatggcgtgatggtttgtggcaaggccgcaaaaagcgtcaaaatcaatttaaacgaccacttaatatttatgaagtccatgcaagttcttggaaacaccacgcagatggaaccccttatcgtttttctgaattaaaagatgaactcattccttacctcaaacaaatgggctacacccatattgaatttatgccattgatggaacatccattaggcacatcgtggggttatcaattgattggctattttgcgctcagcgcttattacggcacaccagaagaatttcaagattttgttgaagcctgtcacttggaaaatatcggtgtcctagttgactgggtgccgggccatttttgtgtcaatgatgattgtttggcttactatgatggaacgccgacatttgaatatcaagatgccgatcgtgcaaaaaatgttcgttggggagcaatcaattttgatttaggcaaaccacaagtacaaagtttcttgctatccagtgcccttttttggatcgaattttatcacatcgatgggattcgcgtggatgcggtttcgaacatgatctatcgagactacgaccagggtgtttggcaaccaaatcatgaggggggcaatcgaaattatgaaggttattacttcttgcagaaactaaatgcagtcgtgaaactggcgcatccagaagtgatgatgatcgctgaggaaagtacctcagaaacgaaagttacaggcctgattgaagaaggggctcttggatttgattacaaatggaatctgggctggatgaacgatgtcctgcgtttttaccaaatggatccaatcttccgtaaggatcatttgagtttgttgtcgttctcattcatgtaccgcatgaatgaaaactatatattacccctttcccatgatgaagtcgtccatggcaaacgtagcttaatgcacaaaatgtggggagatcgttacaagcaattttcacaattaagaaatttgtatacctacatgatgacccatccagggaagaaactgctgtttatgggcagtgagtggggacaatttttggaatggaaatatgatcacgggcttgaatgggtcgatttatcagatgaactaaatcagcgtatgcagcaatttacaaagacactaaatgaactgtataaacaggagcgctcattgtgggaaatcgaagataaagaagaatcgctggtagtcattgatgctgataacttagcggaaacaacattgacctatttgcgacaaggtaaaaccaaaaaagatttcgtgatcgttgtattgaatttgacacctgttgaacgccacgatttcgccattggcgttccgtatgaagggacctaccgtgaagtattgaataccgaacgcgatagttttggcgggacttggacccagaataatcaagaccaacaaacagaagcgattccattcaaagaatatccttatcaaatcaaaacaattttgccagcacttggggcattgattataaaaccagaaaagattcaaatcaaacgcaggaaaaaatgaaaggggggaggagctggctcgaaagtccaatcgaagtgacaacgtgaaaggtgatatcgaaaagaaggctttttgaaagaaaagcattcatatcgaaaataacaccggcatcgtgaaagagattggctttttagcggctcaagaaaatgaaaacagagatgttagcgatgatcctcgcaggaggacaaggcacacgtttagggaagttgaccaaaaatattgcgaaacctgcagtaccttttggtggtcggtatcgtattatcgattttacattaagtaattgtgtcaattcagggattaagaatgttggtgtggtgacacagtatcaacctttggcattgaacagtcacattggaaacggatcaagttgggggttagatggtatcaataccggagtgacgattttacaaccctactcaaattctgaaggtggaaaatggtttgaaggaacagctcatgcgatctatcaaaacattgcctacattgatgaaatggaccctcaatatgtattagtattatccggtgaccatatctacaagatggattacgaagaaatgctggaaaaacacaaagaaaacgatgcgtctcttactgttgcagtgctagaagtgccaatgaaagacgcttcccgctttggtatcatgaacacagataaaaatgaccggatcattgaatttgatgaaaaaccagcagagccaaaaagtaacttagcttcaatgggaatctatatctttgactgggctcgcttacgcagcgtactgttaagcaattatacaaaagacggcgaaatggtcgactttgggaaacacgtgattccatcttacttggaaagtggcgacaatgtatttgcttatcgtttttcaggctattggaaagacgtgggtaccattgattctctttgggaagctaatatggaatttatcgatccacagatggaactgggaatccgtgataaaaattggcaagtcttctcaaaaaatccgattgctcctcctcatttcattacagaaacaggttctgcaaaaaattcgttgatcatggatggttgctatgttgctggagatattgaacatagtattttatcagaaaatgttcaagtcaaagaaggaactaagatcacagatagtgtggtcatgcctggagcagtcattgggaaaaatgtaacactaaaacgcgcgatcattggagaaaatgcagtgatcggtgatgatgcagtcatagacggaacagatgaaattgctgttgttggttattctgaagtgataggagtgacgattgatgagaactaataaaatgtgtgccattttaggcaatctgcaccgctacaaagaactgatgcccttaacggaaagtcgtccgttgtcgacgctattgtttgattgtaaatatcgtttgcttgatttcaacttgtcaagtattgaaaatgcaaatatcaaacaagtgtatatgatttttaatgaaggagaaacacaatccgtatttgaccatatcggtggcgggaaagaatggaatctagatggtgttcaaaaccgtttcttcattcatttgttccaagactcattaaaacagcaagctgctggtcaagagtattactataacgtgatcgattatttggaaaaatctaaatcagagcatacggtttatatgggcagcaatattttgtgcaacatcgatttgcgggcgttgctgaaaatccaccagttacagaataaagaaatgacggtcgtttataaacgaatcagcagcgataacgtaagtgacaacgacttaatcttttcagttgacgaagaaggccatttgaatgaagctgtccaagcgaagaaatgcgagacagaaagtatggtcaatctttgcactgatatcttcatcatcaaaacagaccgcctgatccaagctttaaaagaaggacaagctgtaggtgctactccagacctaggtcgtttcttgcgggaacgaatctctatcgaaaatactagcttgtatgaatatactggttatttaagcaatatttatgatattcaatcctattaccaaaccaacatggatatgttagatgtccacaaatttacctcattgctttactcaaatcaaaagatctacaccaagctgaagaatgaagtgccaacctattacgctgaaacttcggatgtcaaaaatagtcactttgcttctggttgtatcgtagaaggatctgtcgaacggtcacttgttgcccgtagaacaacgattcatccgaatgcccatgtcaaagacacgatcatttttgggaataatgaaatcaaggaaggtgctgaagtttcctatgctattctcgataaaaatgttgtgatcgcagaaggtgtcaaagttagaggaaccagtgacgcaccgatcgtcgtcaaaaaaaatacccatgtcactgaagatctaattggaggagcaacggcatgaaggtactatttgccgcagcagaatgcgcgccatttttcaagacaggtggactaggggatgtcgtgggtgcattgcccaaagaacttgtcaaaaaaggggtagaaacagtcgtggttctgccattctttactaaaatgtcagccgactatcaagaacagctggaagattgtttttcatttgaagtcaatgtgggttggcgtaagcaatattgtgggttgaagaaactagttctcaatcgtgttacctactattttatcgataatctgtactattttggtcgtgataatttatacgattattatgatgatggcgaacgttttgccttctttcaactagcaactatcgaaatgatggagagaatcgattttattcctgacgtgattcatgtgaatgattaccatacagcaatgattccttttcttctgaaagaaaaatatcattggatcaatgcttatcagaatatctgcaccgttttgacgattcataatattggctttcaaggatggtatagcaaagatattttaccggacttgtttggcatggggacagagcgttacgatgacgggacattacgattaaatgactgtttgaatttcatgaaagcaggtattttatacgcagatcgtatcacaacagttagtccttcttatagtgaggaaatcaaaacaccggaatttggttgcggacttgaagtcattctaagaatggaatctgggaaactgcaaggaatattgaacgggatcgattatgaaaccaacgatcctgcaacagatccattgctgccctatcattttacttccgatgaaatgtccggtaaagctgcaaacaagcaagaattgcaaaagatgctggggctaccagcgcgtgatgtgcctcttatcacagtggtcagccgcttgactacacaaaaaggctttcatcttgtaatgccggaaatggaaaacttattgcaatttgatgttcaatttgcgcttttaggaacgggagaaccggaatttgaagaaggattccgttactttgctgcaaaatatccggaaaaatgtgccgcggtgatttcttttgatattggactggcgcaaaaaatgtatgccggagcggatctgttcttgatgccttctgcttttgaaccttgcgggctttcacaaatgatcgccatgcgttacggaacattgccagtcgtgcatgagattggcggactaaaagatacggtagattcatacaatccaatcactcatcaaggcaccggatttggtttccaagagttcacgtcattttatttgatgaatgcagtgaaacaaggaatcctgctttatcaagacgaccagcaaacgtggaaatctttgcaagcacaagccatgaataaagattttagctgggacattagttccaatcaatatattgatctctaccaagcgatcaaagtataatcaagtataagacagaagtattcattagtctgaaagtagagcgggtttgacagaacgacctagcgacaagggcgattggtgcttctgtcctttttcatacaaattgatagtcataaaggagtgaattgtaatggagaaagctaccttgcaagaattattagaaagccggttgaaagatattttttcgatcgagatcgcagaagcttcaccgcaagaattgtttttagctttagctaacgtggtcaagagctgctacgcgaatgattggagccagacacgaaaaaatctgctcgttgaacagcagaaacaggcgtattatttctcgatcgaatttttacctggaaaactgttgaaaagtaatctactgaatttagggtttctggatactgcggaagagctcttcgaagagttatccttttcattagatgaagttgctgaagttgaaaaagatatggcattaggaaatggtggactaggacgattagcttcttgtttcatggattctttggcttcattagggttgccaggaaatgggaacggcatccgttataattatggcctttttaaacaaaagtttgtagatgggcatcaagtagagctgcctgacgactggttacgtgccggaaatgtctgggaggttcgaaaggagagtaaagccgtggatatccaatatggcggcgaagtgtacttgattgaagacgagaatgggaggctgcgtcctgaacggcatggtgggtatgtctggcgtgcggttccttatgataccggaatggttggctatcaaaatgatatgatcaatacattacgtttgtggagcgttgaggttcctgcagcggaagaagccaactatgcaaccattgaatctcgtcgttctctagaagatctgaccgctgtcttgtatccagatgattctaatgaacgaggcaagaagactcgacttatgcaagaatatttctttgtctcagcaggcattcaaagtattgttcgctactatttaaaattgaatcatccgctaacgatgatgagtgaaaaaattgctatccatatcaatgatacccaccctgcattatgtgtatccgagttgatgcggttattgttagatgatcatgatttgccatgggaacaagcatgggcaatcacagtgaaagtcatgagctataccaaccatacgattatggctgaagcgttagaaaaatggccgattgatctattcaaagaagttattcctcggaattaccaaatcattgaagaaatcgatcgtcgttatcttgaagagtatgcagaggttcacgaagctgcccttcttaatcggacgcgtattattattaatggccaagtccatatggcgcatttagcgattattggcagccatagtgtcaatggtgtcgcaaagctccattctgatctgttgaaatccgttgtcctacatgatttttatttgatattcccagaacgtttcaataataaaaccaatgggatcgcacaacgtcgctggatgcagttagccaaccaacctttatcaaaggtgcttgatacgactatcggcaaaagttggcgccataacccgcaagacttgcaattattgaaaaattaccaagaagatccaacagttttgcaacgtctagcagatgcaaaactgaccaacaaacaagcgttagctgaatatatccagcagacaaccgggatcgaagttgatccaaccgcgatatttgatgtccaaatcaagcggctccatgcgtataaacgacagttgctaaatgtgatgcatattttgaaactatactttgacttgaaagatgaccctcaagcaccgattcatccacgggtatttatttttggagcgaaggccgcacctagttatcattatgcgaaagccattattaaagtgatcaatgaagtagctaacctgatcaatcatgatccgacaatcaatgataagctgaaagtcgtctttttggaaaactacaacgtcacattggctgagcggatcattcccgcagcggatgtcagtgagcaaatttccttagcatcaaaagaagcttccggtacgagcaacatgaagctgatgttgaatggggcagtcacgatcgcgacattggatggcgcgaacattgagattcgagatgcaatcggagatgagaacattgccatttttggattaacagaagaagaggtctatgcttattatgcccaacaaaactattctgcgtatgcgttttacgaagaagatcctgtgctgcaacgggtcgtgaatgcatttattgatggaacgatcccaaatatagaaagagaaggtcgggaagtgtttgattcactattaaaatataatgatgaatacttcttgttgaaagacttcaaatcttattgtgatgcccaatatcgcgtggatttagcttataaagaccaacagcgctggcaagcgatcagcttgatgaatattgcgaatgccggcaaattttccgcagattatacggttcaaaattatgctgatgacatttggcagatcgaaccattgtatgcacatgtcaaagagccaaattcagctagtctgacgtaataatctattgtacttgctcattgaatattcccaaaagacaccacagctttcgtgaattattcactgaaatatgatatgattagataaaatcgcaaccagaggatgagtgaattggcaaattatttagatgtgaaacgcaaacatttccgttttccagcatatgatgatcaagaaggggtaaagctgcagtccgaacacaaggaagttttcagtcagtctgatgattggattttgacagaaatcaaggatcaacctagcacgagcagcaaagaaaaggattctgctcactcattgcgtcggaaagttccttccagtcaccccaattacggtcatagtgtgcggcaaaaagaagaattagcgcaacatcgggcaaatttaccaagctatggaaaacgacctttgcaggaaagtacacctaccggcaaaacaaatctttttggcaatgatcaacgacgtgcttcttataaagtgacgagtaaagcagaacgggctgaaacgccaacaccgaccaagaaagagtattctgggcgatcttattttgttcccaaatacattcctgcatcgatcatccctgaacaagaaaaagaagagatcacttcacaagaactgatggattcaatggagaaaccccgcgaatcctatttgctctttgatactgagccagcagcctaccaagtaaaagaaggcgatgatcccacggtcagaaagttcaatcgaccgcaatctgtaggcatgacacggcgggaatttcgcggcatgaacaaaaaaaacggcgataagcgagctgttctagatcgttccttagaaggaatgatcgaagaggggcagtcagaaagcaataaaaatggctactttcgctcttgatgagtaggacaactgaaataagcaaaggcactcgtgagaatctctcgctcaacaagcagttgggagttattcgttaataaaacaaggataatgatttaaacaacaaagaaagcaactatctgaattgtagatgaagctgtggcgctagcttgctggatgaagtaagctgacaaaaccagtcgctatcatctgtgatttggatagttgttttgtgcttcagaataccgctagtcttttcaaaaaatatcaagaaagctgaagcgacaatttccgttaaagaagcggcagctgtcctccttgtttttatttgttgaaagaaaacggtgactaacagatggcaacttctcaattattttcacttttgagaagcatttgctattcttaaaagaggagggatacgggatggaaattgatttgcaaatgttagcgatgatcttctttatcaatatggcttatgtcacattgaatacaattcgttttttattgacgatgaaagggtatcggctgattgcaccgctggtcagtatggtcgagatcacgatttatatattaggattgtcgatggtattggatcgcttagacaatccattgaacctactgttttatgcattaggttacgccgcaggagttagtgttggaatcaaaatcgaagatcagctagctttaggctatacgatggtcacggtgattttaccgacgaatacagatgaagaaaagaatttgccaaaaattttacgccaagaaggatatggtgttactcaaagttacggagaaggattagaaggtccgcgattgatccttgaaattctctcacaacgcaaaagcgagaagaaactgtttcaaaaaatcaaacaaatcgaagaacgggcctttatcattagctatgagcccaaatatatttctggcggcttttggacgaagaaaatcagtcggagagaagctcgggtcaaaaaagaacaaaaaaaggaatagctctttttctctcctgtgcgacggtccttttttgagatataataggcaagaatttggtttggaaggaagcgaatttgaatggaaaaacaagcaaacggcatgatggcggtgatagcagcactcatctcgaatattttagttgccatcagcaagtttgtcggctacgcattgagcggcagtgcggcgatgttgaatgaaagtattcacagcgtggtcgattgcagcaatcaaatctttctgttgatcggtgataaacgagcaacgaaagggcaaagtgaacttcaccaatttggcgaaggacgcgcgaaatacttctttagtacgatcgtagcgatgatgctgttttttggtgggggcgctctaggtgtaatggaagcttttgaaaagctgctgcatcctgctcatgaagttggtaatacttggctagtgattggtattttgcttttcggtttagttgtagaaggtagttctttgtggatcgcgatcaaagaaattcggaccttgaacgtagaaaagcagcctatttatcggtttttgaaagaaagtcgccatagtgagatcttgattatctttaccgaagacttttgtgcagtgattggcttgatgttggcaatgggtggaacgatcttgacaatggtcactggcaatgcgttttttgatgctttcagtggcttgctgatcggtattttgttgatgattgctgctatctttttggcacgagaattttacagtttattgattggcgaaagcgtgacgaaaagagatcttgtactgatcaaagaagcctttgatcgtccagatgtcgatcgattattggatatcaaaaccgttcatttaggtcctgcggaaatcttagtcgctgccaaaattgatatcacagcaaaacaagaggagatcggttatcaaatcattaacgagatcgaagcaaagatccgcagcttcatgccggataaaaaaatgtatatttatattgaaacggatgagtatgatcctcattatatggagaaacggcgaaaacttgtccgatcacaagactgatttttgtagaacaaagccagtttttttgatacaatagacaaggattatctaagacgaaggagaataaaccattatgatcaatgcaagtgatttaagagcaggaatgacattcgtgcaagacggcaaactaatcaaggtattagaagccagccatcacaaacctggtaaagggaatacagtcatgcgtatgaaattgcgcgatgttcgttcaggttcaacctatgatacaacattccgtccagaagaaaaatttgaaaaagctcatattgatacgaaagctgttcaatatttgtatacaatggacgatacagcgttcttcatggacttggaaacctatgaacaatatgaaattccggttgaagttgtagaagaagaaatgaaatacattctggaaaacatggaagtgaagatccaattcttcggcagtgaagtgattggggttcaattaccatcatcagtcatcttgaaagttgttgaaacacaaccgtcgatcaaaggtgcgactgtgactggctcaggtaaaccagcaacgatggaaacaggtttggtcgtcaacgtacctgactttatcgaagaaggcgaatctctagaaatcaatacttctgaaggtacgtacatcaaacgcgcgaaataatcattttctagaagagccaaggttttatgaacttggttctttttcttttagaaagaaggatcaacatgaatgtacttgttgtggcattttttgcattttttggcggcatggcacgttattttcttgcttcggaattgccgtcttggggcatcttccctttaggcacattactggctaattttattggctgttttatttttagctttttagtcaagcagatcatgacgaaaagacacttgaatggacgtttgatcttgggcatggggaccggattttgcggtgctttgacgactttttcatcctttgcacttgacacggtgcagttgctgcaaaagcaagcctatggattagcgacggggtatttgatcctgtcgatttgcggcgggttattttttgtctggttaggcgaagccctcgttagaaagcaggtgtaagtatggcatatatcgttgtaggaattggtgcagccatgggcgctgtcctgcgttatggtatcaatcgttattttgaacgaagaccacatccttttcccaaagccactttgctgattaatttatctggtgcgttgatactagggattcttgccggtcttcagattgatcaacacttgtatcttttgcttggaacagggatcatgggcggttatactactttttcaacaatgacgattgaattatttacattgctaaagaccaatcgccagtacttttatctttattttttcagtacgtacattgtaggattgacggctagttttattgggttgatgataggtgcttatttgaactgaaaaggagtagacgatgattgcattcatgtcagcagaaatgtggcttaaaagtgagtttttttattattcaatcgttccggttttattagtcgttggattagtggcgcttttacttttgctgatccttttgttgtatcgggagaaccggcggcagggtttgatctggctgcctgtcgtagttttgttgctttgcggcggcggtttcttgttaggagatcatttttttcacgactttaaaaatgacaatgcacaaattacgccaaatatccgcgatcgggaaaaacgctttatcggatataaatattatgatcagagcacgttggcggcttatcagcgaatccaaagtgaagccattccttctctggggatctatcaagcagaaccggttagccgagaaatccaatttctgggtattgcgcacaactctgtgtatttcaaactaggagaacagtattactatttgcgccaagagccaatctttgcgaaacaagaacaagctgagctgcaaggtgtccaataccatctgattgagtccgcttttgcagacatcggtttttttacagaaacaaacaattatttaacagccatcgttttgcctgagagcaaaaaagagttagtctatgaatccattgatgggatcttgccaaaagagtttggcaaaagtcaaacagcttgggcagtccctggaaaccaataaaaaatgtcattacatgagacaaaaggataggtgaatcatccgattcatctatccttttgtgatgtctttacttcccattgaagattgagcattcaaaacatttttttctttctgttcagtcaaataacgttctttgtgtttgcgcaccagttttttaaaggcagcttccgcttttgtggcttcactacgggtagcaaaacattccgcatggatcatttgtaaggggcgacgactagctggatgagtgtactttgctccaatgccttgattgtgttgatgcaggcggcgtatcaaatctgtggtataaccaccgtaaaaggtattgtctttacagagcaatacatagaagtaatgcgtatcagctgccataaagcatccgactcacttcctcactgtagctcccatccgcatgataagtgatcagcggtgaggcaatcttgaaaccatcagctttaccatccttgatgccctcgatcaataggatattcgcgtctttccctgctttgggatagacgaaacggacacgtttgggtgcgattcgatattttctcatgcagtctaaaatatccaaaaaacgatcaggtcggtgaaccatagcaaagcgcccattcattttcagcgctttactggctgtgtagaccacctcgtctaatgtggtctcgatttcatggcgagcaatcgccagataaggattaggatttttaacagcagtgggaacatttttgaaatagggcggattacagaccaagagatccaccgagtccggtttgattttggtaaagatgttttttaaatccattgggtaaaccgttatttgttcctcaagcccattcaagcttacactgcgttgggccatatcagccagccgatcctgcagctcgatctggtaaatgtgagccgaagttttacggctgataaacaagccgactgcaccatttccagcacacagatcaacgattcgtccccgtttgggaatcgttgggaagttagctagcaaaacggcatcgagggagaaagaaaagacctcgctgctttggatgattttgatatcttccgcatatagttgatctatgcgttcgtttgattgcaacatgaaagcatactcctgttctaattcatttcctttgtattatactacgattaagaataatcggaaacgacaaaaaaggcttgtcatttgaagcgtttttttgcatacttataaaagaaactggaaaggaaagtgagtatgttttttagctttatgcgaggcgtggttcgggtcattttgtttttgatcaacgggaacgcccgatatcaaaacaaagaggctttgccgcaaaatgaaaattacatattggttgcacctcaccgtacctggtgggatccgttgtatctggcggtggctgctcgtcccaaaaagttcagctttatggcaaaagaagaactgtttaagaatccaatcttgcgctttattttgattcatgcgaatgcttttccggtaaagcgtgacaaaccagggccgagtgctgtcaaaacaccggtgaaaatcttaaaagatacagatctgagtctcattatgtttcctagcggaacaagacattcgaccgcgctgaagggtggcatggcactgatcgccaaaatggcgaaggtaaaaatcgttccttctgtttatcaaggtcccttaacgctaaaagatttatttaaacgtcgacgagtaaccgttcgttttggggaggcgatcgatatcagtgatatcaagaaaatggataaagaagggttagcagaagtggaacgccgcattcaaggtgcttttacaaagctcgaccaagaaatagatccgaattttgtttatgaagtagaagagaagaaacgttgatgcgtttcttcttttatttttgactgtgttttaaataaatattgaacttgataattttttgaggatatgctatgagataatcaataacaagggtttagttacaggtttagagggcctattatggcaaatagtaattctttgatttcagatgttcaaaaattatttgtgaaagtagaatatataaatacaattagatacttgttttatagtgcaaattaaaatgaagatttttacacatcgaggaggtaaaatgatatgaagccaaaagaaatactttgccaatgggttgacgcatttaatcatgcggatgtagaaattatttcagaattatatgatgacaatgcaataaaccatcaggttgccaatgagccagttattggaaaagaggctataaagaaaatgtttgaacaagacttctctaacgcagaaatggtttgtatcgttgaaaacattttcgaagatggacaatgggcaattttagagtggcgtgacccgttaggtttgagaggttgcggtttttttcaaatagtaaataataaaattttatttcaaagaggctactgggataagctatctttcttgaaacagcacaatttgcctattgaataaaatgaatagatatcttatataaatagtttgtaaatttcttaaaaggtgcattaaggtaaggataataatttcccttaatgattgttagaatagtaacactgcgttaaaacatagtcttatttctaatttctaaagtaggcttgcttcgtgcttcttacctaggaaaagcagctccttattggtatgctcaaaaaaattttaaaaaggagtctctgttagacagaggctccttttttagctcatcaagagttattcagtgactggttgattttccttttccaattcatttttgtcatagatttttacaaatggataataaatgaggatggaaagtacaatcaaaagaatgtttaagacgattgctcgccagtcaccgcctgttgcaagaaaggcaccaattggtcctggcaatgtccaaggggcattgacggtcactttgttgactaaaccagccgaggtggctacccaggcaattacaccattgactaatggtgcaatgataaatggcggaatcaaaattggattcaagacgataggcgtcccaaaaatcagcggctcattgatattgaaaatagcagggatcaatgcggtttttcctagttttgatccgaattcggattttgtacgaaaagcaagcaagatcgccagaccgatggttgaccctgcgccgccgatccaaatgaaccattggtagaatggctcagcagcaatgttgggaatcacatcgccagaagctaacgcagtggtgttgccttccaataattgcagccataacggccgtgccagtgaaccaacgatcgaggcaccatggatcccaaaggaccaaaagaatgtcgttaagaaagtgatcaataagacacttggcaagctatcggctgcgctaactagaggatcaacaacttttgctacgatggtatgccagtcaaagccaatgtaataggtgattacccccatacctaaaataatgatcaatgttggcgttaaagcttcaaaagatcgagcaacagcaggagggacttgttccggcatcgtgattttaaatttagatttatccgtcaaacgataaatctccacagctaaaatcgatgtaatgatcgctacgaacatcccggcactgcccaagtttgccattggtaaaacaaatccggctgtaccagcagcctccaaagcttcggggggaatatttattggcgtgaaagtcaataaaaaagctgtggtggctaagataccaccagagagaccatcgagtttataggaacgggctaagctaaagccgatcccgaatgcggcatataaactcataatgtacatcgtcatgcggtaaggaagcaagatcgtggtcgcatggctcgaaagaaattgatagattccccagtcttgtggcaggggaggaaaagccaaaatcataaaaaatgagctgacgataatcagtggcaaagtagagacgatcccatcgcggaccgcccgtaaatgccgttgactccccagtttttccattggtccagccaggtgacgttcaatgaactgtgtaaatttatctaacattttttaacctcctgtgaaaacgttcatatggttgaattaataaagttatgttgggtgattccgctctcctatgggaccaaatggatttgggatgatctttcccagaatcacggattgtttggcaccagtcgcggcaggagcattatttttatgtccctgtaaggtctcgtatcctaaaagggcaaatgccatagcttctttcgcatcattggaccaacctaaatcattttgggtaatcactgtaatctcaacgggtaagtagttgaccagcattttttttagtgttgaattatgcgcgccgccgcctgctaaaatcacttcaatgggtccgctttcaacaagtgggaaaacgaagcgccgataactctcggcaatcgagtaggcagtaaaatcggtcactgttgctattaagtctgctggtttttctgcagaaaaatctgctaatagttgatcactgaatgcttgaccaaatagttcccgtccagtgctcttagggggtgcttgatcgaaataggaatgatttcttaattgtgtttgcaatttaggaataatggttccctgttgagcaatccttccttcagcatcgtaaggaagttggaataattgatgcatcagttcatcgatgatcatatttccaggaccagtatcgaaggcgacaagatcacttaatgtgccatttttcggcaggaccgtcacatttccaatcccaccgatattttgcaataagcgggttttatcaggggaacgatacaagagataatcagtataaggtacaagcggtgctccttgtccaccagcagccatatccatcgcgcggaaatcggcaaccacagttgttccgagtccgtaggcaatgattgacggctctccaatttgaaacgtactggaaacaagcgggttttccgagggtgcatgccaaatagtttgtccgtggctagcaacaaagtcaatgctagtttcggttactgctgtttcttggcagacctgacgacaagcagcgagaaaggcatagcctagctcaacatttaactgacagatcaaggaaacagaagagtcctccgggtcacaggcttgttttattctttggcgcaactcgggggaaaaagcagtagtcgtcagatgcaacagacgaatagatggctgtgaatgattatcgatttctactaatgcggcatcaacaccgtctaaactagttccagacatgagtccaattccaagcattgtttctcctcctttcttttgtgtttgtcgaaaccaaattagatgaacttgggcggaaatgtattcggtttcaacctcgtctttattgtagtgtatgtgtaattgcatttcaatgatttttttgtaaaaggaaatttaatttcattaatttgacaaatcagtgtgagaacccgtttggaaaaagaaggactcaattgtctgggaacgagaagatcacgttgatacattcaattcataatcgtaaagtggtataatgatgggaaggatatttttaagagggtgggtatatgcgttttttacatacagcagattggcacataggtaaaaaattacacggctatgatcttctcgaagatcaaagttacattattgaccagataattgatctggcggaagaacaatcagtagatgcaattatcattgctggggatctttatgatcgcacggtgccagccgttgacgcagtgaaatgtttaaatgagaaaatagcgaaaatcaatttagaaaaaaagtttcctttactagcgatttctggtaatcacgatagtccgacacgacttgaaactggaagtccatggttcaaaaatacgcaattttacctaacgacctccattgaagaaagtattgagccgattgaattttctgacacccagtttttcttgttaccttattttgaaccgatcgaagcgcgtttgttttttgatgaaaaaatcacaacgatcgcagaaggggtgactcgggtccttcaagagatgaagcagtattttgattctacgaaaaaacaagtcctggtgactcacttttttgtagctggttcaagccagacggattcggaaaccaaaattcaagtaggcggattggatagtgttccgacaacggcgtttgaagggtttgactatgtcgccttaggacatctgcatgcaaatactgcgctaaatcatgaacgaatccgttatagcgggtctccgttgaaattttcattgtctgaaataaccaatgagaaaggtgtttatatcgtagatactcaaaaggaccagcagcatttttatccgttgcggccgaaaagagatcttcagcaatacactgcttcttttgaaacattgcttgatcctgccttttatcggcaagtggatcgagaggccttcttacacttcacgttaacggatcgagccgtaattcctaatatgatgaatcaattacggcgggtctatcctcgaattttatctgtggagcggcaaaatgggcgaaccgtcagcaagaaaaatttgacattagccgatgaggaggatccgcaacgggtgatcgcccatttttataaagaaatgactggagaaccgttaaatgagcagcagcaaaaatggctcacaggtttgacagcgggtggagagaaggagcgagagaagtcatgcagccaagaaaattaatcatgaaaaactttggtccctacattcatgaggaactggattttggcgactttcaagaaggtggtttgtttctagtcagcgggaaaaccggggctggcaagacgacgatctttgatggaatgacatttgcattatttggagaaacttccggaaatttgcggtccggtaaagaaatgcgttcgacattcgcttcccccacagaagagacgagtgtccgtttttcctttgatcatcaacatttgcactatgagatcgaacgacgtcccgaacaagtcttagccaaaaaacgcggcgatggagtcacgaatcaagcagctaaggtacggttgacgatctatgatcagcaaggaaaagagcgcaaacaaatcagcaaaaaaaatgaagtagatatcttcatcaaagatctgctgcaattggatgccaaacaattcttccaaatcattttgctgcctcaaggagaatttcgcaattttttgatcgccagcagtaatgagaaagaaaaagttttgcggaatatttttggaacggaaatgtatcagcgcttcaatgaatggctgaaagaacaggtcaaaaagcaaaccaaacaaattgaaaaacaacaaacggcagcggatcatttggtcacacgctttgagtggaccgaaccggcaactccggtttcgttggttgagacattagcgtactggcagacagatcttgagaaacaacgaagtcatcagcaaacaattgaagcaaaaaaattccaagcggagcaagagaaaaagaccgcacaggaagctttttatttggcaaaagaaatccataaagcacttgccgagcaacaggaactcagccaacaggcagcgaatctagctgcgaaagaaagtcaaattttagacgataaactgcggctgcagcagctagactgggcgagtgagcatcaagaaatcttacgccaaaaagatgagcggacagctgaagtagcacaggctattcaacaacttacattcaatcagcaatcattagaacaatggcaagagtctcaagagatatgggacaaaagccgagaagttcaggtagatcgaaaggacgaacatacagcagctaagcaacgtttacaaatactggcacagttaaaaccattagccgagcaagttcagcaacaagaaaaacaggtcgcttctttgcaggaaacggtgactcaacaggaaaaacaagcgcagcatctgaaagaacagcaaaatcttgctatgaatcaggagcaaggattaaaagaagaaatccaaaagcattcgatctaccaagtacaggaagtccaactggttcgtggagaaaatctgttgtaccaatggcagatgttgaaaaaagaggagcagcagctgactgatacccaacagcaactaacagaccagcagcgaaaattgcaagagaagcagcagcagttagtaagtaaatatgatgagttaactgaagaattggtgcaagaaaaaagtcgaaatgccaagatgcagattgctcgtttgagtctcttattggtggagggggaaccttgtccggtctgtggctcttttgaacaccccgctgctcaaaaacatacagagtatagtaatgaagaaatcattgatagcgagcagcaacttgaatctttggagaaccagctgcaacaagttggtgaagaccgttcgacgaacttgctgctgctagaacaagtcaatgaccagtttcaaacaattaaacaaaaaatgagcgcgttgaaggaaaaacaacagacaacgtatcagacactgcgagaaatcctccagccgttgatggaaaatatgctaggtcaaacagtcctgaaagaaggagctggcaaggaaccagctgacccattgctggtagaaggattgactgaaaaggaaatttccactacctatttcaaatgccaacaaatcaatcagcagttgaaagagcaatttgctctagacagacagaaattgacagaggtccaaacaaacagccaacatcttacagaagaattgacagcacttgaagcaagtctcaagactgctagtgacgctttacgtttggaagaaggaaaactgtcctcactaaaagagcaaacggagggagtatctctggagcagttgaacgaggaacaggagcaactagcagcacaatcgtctcgtttagcagctctgattgaagcggatcagttggaagagcaacgtttgaaggaacagtatacgatcctgacagagcagcaacgaaatctgcaacagtttctagccgacaagcaacaagctgctcagctagcccaagaacgcttggaagaagtcttgcctgcggcatgtaccgaacaacagatgcgcagtctgctcaatgatcttgaggaacgccaggagctacgcagtacgataaaaacctatgaacaacaacaacgttttgttcaacagcgacagcttgaactggcacaatttttgcaaaacaaagctgtgcctgacttggaagtcttgcaagaacaagtagaccagtctgaaacagcggtagaacaattacaagaacaagtaatccgaggaaaagaacaaatcaagcaaaatcagcgattacttgaagaattgcagataatctatcaacaaaacaccaagcaattagaaaaaatcagccatttacagcaactatcagaagtcatcaatggagaaaatgaaaagaagaccagtttggaacgctatgttctgcaacgatttttaacagagatcttagaagtggcgaatgttcgcctagctcgattgacaagaggacgttatcaattcgagttggcagacaaagtggggagctatcgaagctcgacagggttggagatcgatatctatgatgataatgctggcagtcttcggcgagcacataccttatcgggtggtgaaagttttattgccgcattggcattggctatctcattagctgatgtgatccaaaatcgttcgggaggcatcgagatcgaggcgttgtttattgacgaaggatttggctcattagatgaagaatcgttggaaatggcgatggaagcattagaaatgattgaaaatgaagggcggatgattgggatcattagtcatgtaagagaattaagagagcgaatcttgcagcaagtcgttgttcaaacagatggcagcggacaaagcaaaattcgtacaaaactttagagaaaggaggaatcagaagcatatgaaatggagtattccagaaaaagtcattgaaagaggtcggacctatctaaatgaaggtcgcgtcctatcggttattccagatccagagagaaaggtatggcatgcggaagtcttgggaagtgagctatatttagtcgatcttgatgcgacggctaaagagatcgattattgccaatgcccctattgggaagaacatcactattgtaaacacactatagctgttgaactttatttacgaaagcaaggcaaaacaagacaaatcacagaagaaaaaaagccaacaaaagccgcattttcggcttcggagatgttttctcagggattcaatcgattgcagtctggacagcggacgatcactcctttgcaaattgaatatcgtgtcgaaaatctgaccacgaacccttaccaccaggagatggatgttctagggatttcactaaaagtcggtcaacggggaacttcaaagacgtatgtcgtcaaaaatatctataaatttttgcaagtctatcaagaaaaaaagagctatctggcgaacaaacaaacagagtttcttttaacgagtgaagcatttgaccaaaccaacaatgatattctgatccgcttactaggcattgctcagacacagcagctgattggacaagctggcatccaagtgaaaggcaaactagacaaaaagtatttgctattgccagttgaatacgggaaagaactattagagaaaatgaacgctgcttatatgcagttaacgattggcaacgctaaacttcgtcaagtgactttttctgaaggcaagccgctgcattttcgtgttcaaaaagaacacggtcaatttccgttatctttgacgagggattttgatcacttgctgagctattacaattggggccttcaaggcgatacgatcgttgaattgacgatggaccaaaaagaagtctatttgacgatgcagcaattattcaaacgctttgaagaaccaacgatcatttatccaaaagcggaactgtccaacttgtttatgcaagttttgcctcatttacgcaagatcggcacggtagagatcacaaaagaggtcggagcagagatccaagagagtccgttagccgttgttttttcactgcgtaaaatcaaaggtcagatcgatttgcaaattgatttcaattatggcgaagtgactttttcgactgacgaaaagcatcaagtgattcctgaggcccatccagagattttaagggattaccctcaggaaaagcggatcgaacaagtagttgaaagaatgaagtatcaaaaaagtaccaaaaattggttcaaagcgctaccggaaggggaagaattgtttgcctttttcactcgtgaaattcctttactgcgccaactaggagaagtacgtatcggcaaaaaattgcgggaactttacttagatgcacagcagcaccgtccaacgatcgaaattgaagaaaatggttcctggctggatattcactttgatgtcagcgggatcgctgaatcggagatcgatgctgtcttgcggagtttgttgcaggctgatcgtttttacacgacagaaaatgggcaagttctttcactggaaacagaagcctttcaagaagcaagcgccgcgctgaaaaaattacggacagcctttgtatctcagtcaggtacgttacaagttccgttgaaccaaggattgtatttgcaagaagaactagctgaccaagcaacttttagtcaaggattcaaacaaatgacgacagatttgattcatccagaaaaattttctgcaccattgcctcatcagctccaagcgcaattaagacactatcaggaggtcggatttcgttggctgaagatgctgagtcagtatcaatttggcggcatacttgcagacgaaatgggattagggaagacagttcaaaccatcagctacttgttgtccgaaaagcaagagaagcaacagttgaatgctctgatcgttgcacctgcgagtttgacgtataattggcagcaagaaatcaaacgctttgcaccaatgatccagtcggtggtgatcagtggttctcgggaggaacgcggcagccaattacagctgccggcagatgtccgcatcacatcttatgccagcttacggcaggacatcgaccagtaccaagaattaggtttagcgtatttgatcttggatgaggcgcaaatggtcaaaaacagcggaaccaaaacagcacaagcattgcgttctttaaatgttccccatcgatttgcattgagtgggacacccatcgagaataatcttgaagagttgtggtccttatttgagatgatcatgccgggatttttcccaaataaacaacgctacaaagaattgacgacacaagagatcgcaaaaatgatcaagccattcatattgcgacgcgataaaaaatccgttcttcaagatctgccagagaagttagaaacgaattattatagtgtactgacagaagagcagaaaaaaatctaccttgcgtatttgcgccaaatgcgggaagaaatcgcacaaatggatacagcagcatttcgcaaaaatcgtatcagcatcttggctggccttactcgtttgcgtcaaatctgctgcgatccgcgattgtttgtggaagattacgaaggcacatcaggcaagctagaacaggtcaaagacctgattcaagcagcaaaagaaaacggccgccgtgtgctcttattctcacagtttacaagcatgctttcgatcattgaagaagaacttgctcaagaaggaattgaaaccttctatttacgaggaagcactcctcctcaagaccgtttgagtatggtcgatgctttcaatagtggagaaaaagatgtctttttgatctcattaaaagccggcggaactggattgaatctgacaggggcggatacggtcattctatatgacttatggtggaatcctgcagtggaagaacaagccgctggccgggcacatcgaatcggtcagaaaaaggttgtggaagtttggcgaatgatcgctgaaggaaccattgaagaacgaatggatgctttgcaacaagaaaagcgggaactattccaaaaagtcatccaagggaatgaagcccagctgaaccaaatgacggaagaagatattcgcttgattttaagcattggtgaagaatagattcagcgaatacaaaacccttgatacgaaagcaagagacagctaggatgcgaagatttgcatctatagctgtctcttagtttttagcgagccatcacaactgcatctgtaaaggataagataccttctgtcagctcttcaaaagcagttaacgtacagtcagggtgacaatttttgatttcgggagcttggcgtcggcgatgattcagccaaagggcttgccatcccgcttgtttacagccaaagacatcattgtcaaagttatctcccacgtataatgtccgtgagggatctaaatcaaatcgttcttcagcaagctgaaaaagttcaatatccggtttttggtaccctgttgcttgagaaatcagcatgtattctggatggatccagcgagtcaattccaattgatcgattttcttttgttggtgatctgttgggccattggtaatgattccaagcttgataggtaatgaaaccaaggtattgagagtttcttctacggctggatgaagttggatgttgtctagctctgtctcgtaagtcgcttgaaacaatcggctagcatcatttgataaaggagagtagcctaaatcaatcagcgattgacatagtctaaaggtacgaaattcttctaatgtccattcttttgagatgacttttccaaaatggtcatcgctatgtacgcgaaaacgaatataaagaggatggagatctgttgttgctacttcaggtatgatggttgtaaccgcatttcgaaatggtagttgttgatcgtataaagtatcatcgacatcaaagattaccgcattaagcaaaagagacacgcctttcaaatatagtgaaaattttcattttgttttcgaacatataatagcggatatcttgagagaaaaaaagggcttaaagcttgataaataaaggttttatttactaattttagaaatccttggtctcatcgctttttcaaatttgagtgaattttacccttttcaatcgatttctcattttgcttttccagaaagacttgcttataatgtagattaatgaaaaggaggaggaagtgtgttaaaaaggttttttagctattatcggccataccggtcattgtttgtcttagattttacttgtgctgtctttgcagggctgcttgaattggtttttccagttgccgtgaatcaagtgatcgacaagattatgccgcagaacaattttcggctgattttgctcgcttgtttggggctatttttattttatctggtcaatacgatcttgcaatatatcgtggtcttttatggccataaattgggtgtcaatatcgagacagatatgcgtcaagaattattccgacacttacagacacagtcttttgaatattatgacaatcaaaaaactggacgtttgatcagtcggctaacgactgacttgtttgaaatatcagaagttgctcaccacggtcccgaggacgtctttattacgatcatgacattgatcggttcattcttgctgatgctcaatatgcatgttcaacttgcacttgctacttttgcactgattccattgattacgattgcactggttttcttcaataagaaaatgacgaaagtcaatacagagatctatgacaatctaggtgaattcaatgctggggtagaagcagcagtcagcggcattcgcgtgactcagtcttttgccaatgagacgtttgaacatcaacgatttgacggtctgagcggcctttatcgtcgttcaaaaatcgtcttttataaagtgatggcaatcagttctgcctataattactttctgattcgactgatcaatttgtttgccttgatttttggggcctattacgtgatcaaaggggaattgacgaatggacagtttgttggatttatcttgttatccaatgtctttgttcggccaatcgaaaaggtcaataccatgattgaaagctatccgaaaggatttgctggcttcaaacgcctgacagaagagctggacaagagaccggcgattcaagataagccaaatgccatcgatgtacacgcactaaaaggcgatatcgtttatcaagatgtttcctttgcttatgcagatgcgacgaaggtattgaaccatattgatctaacgattcaatccggcgagactgtcgcttttgtgggacaaagcggttctggaaaaacaacgctttgcaatttactgccgcggttttatgaagtaactgagggtcagatcacgattgacggaatcaatatccaagacatgacgcttgcctcactacggggccagatcggaactgttcagcaagatgttttcttgttcccgggaacgattcgagaaaacattgcttatgggaaattggatgcgtcagaagaagaaattgctcaagccgtgaaactcgctcatttagaacaagtaatcgaccaaatgcctgaaggattggaaacagtcattggagaacgcggggtcaaactttctggtggtcaaaagcaacgggtagcgattgcccgaatgtttctaaaaaatccgccaatcttgatcttagatgaagcgacctctgcgttggatacagaaacagaacaagtgattcaagaatcattgaattcattagctgatggacggaccacattgattattgcccatcgtttggctaccatcaaacatgcgacaaggatcattgttgtcagcgataaagggatcttggaagaaggaacccacgagcaactgttagcaacagggggacattacaaagcattatatgatgcccagttcaaaaattagacgaaaaaagcgacttcgatcgcttttttcgtttatatgcaaataaacatattcagtggatatcgctgatttcttcaaagagatttgttaggatttacttatcaaacgctttctttgtttgtaacatttgtcatattcgttgccgatgaaatgatttttcactcataatgagcaactaatgacttggaatagaatacgtgataatacagattttcgtttctttgaaatcttttaataacaagttcttttctctgtttgtaagtttttaacgagttttaggtgtaaaaaaagattggtaaagaccaatgaaagagtactagtattatagaaagaaacttgtatagaggagtcagatattatcgaatattttatcaaaattaaaaaacgatagaattaaatcactagagtgatttaaataaatctatggttcatgatacaattttgacacactgttatacaaaagaaatgaaattaaaaaaaaatttgatttttctcatttaaattgatgtaaagtttgtgaaagcttttgtttgagaggtttctcttttaatataacttgagagttttattaaaaaatacaaaatttacactagattttttttaaatagttctgtataattaaaatcaagcaagacaacagaacttgcgaatggaatttaaaaaaggagagatgcacgttgttgacactatatacttccccaagttgcacatcttgtcgcaaagctcgtgcgtggttgcaagagcatgagattccttttgttgaaagaaatattttctcagaacctttaaatatttctgaattaaaagcaatcttacaaatgacagaagatggtacagaagaaattatctctacaagatccaaagtttttcaaaaattgaacatggatcttgatgacctgccgctaaaagatttattgacacttgtacaagagaacccaggattattgcgtcgtccgatcatgattgatgaaaaacgactccaagttggttttaatgaagatgaaatccgtcgtttcttgccaagagatgttcgtcaactagaactacgtcaagcacaattgatggcaggcttataaaaatcaaatagttatgagatcagtgaatgaaaagctgatctctttttttgccattttaggattttcttaagaggatatgcgttttctctttacttttcaacaggtttcgttaaaatgaacctatagtgattagcaaaagtgaggtgtagctaatatggaaatggaacatatcaatgaaaatacgatccgtgtactgatcaagagcgaagatttagctgctaggggcatcacttttcttgaccttcttggaaatcacaatgagattgaaaactttttttatagcatattagaagaagtagatattgatgaagaatttaaaggcagtgaagcggtgaccttccaagtcttacctaaaggggatggcttagaattgtttatcagcaaaaatctaccgcctgaaggaatggaaaactttgatgatatgagcgatggttcaactgaggacattacggatatgttgaagaagcatgtcgcgtcacaattacaagagacagagtcccagccggagttaggcaatcgttttatttttgaattgaacagctttgaagcaatggttcaattagcgtccgaagtgtatttggattcagtgaccacgaatctttatcagatgaatgaccgttactatctagaagtccaatttatggataacgatacgacagacatcgaagttgagaatgcactggcttatttaatggaatttgctaaccggacacaagtcacttcagaggttttggcagagtatggaaaaatcattatggagcatgacgcattggaattgacccgttactacttcaaaaatgtctaatgttcacttataatcgtaaaagcgagaaaatggctacaatcattttctcgcttttttgcgtatttctttttgaggtgagaagatgattattgcgtatgacaaccagcagcagcggatcaaagctgatcaggcgaagaaagattcagaaccattttattgtccaggatgtcatggaccggtgcacttaaggaaaggcctcctgaaacgccatcatttcgctcattatgctgcggctaactgcgaagtgtttagtgaaggagagacggaggaacatttgtcagcaaaggagctcctctacgaatggctaacagatgaaacgatcgaaatagaagcttacttgccggatttgcagcagcgaccggatcttcttgtgggcaaaacagcgattgaagtacagtgttcggctttgtcttggagccgctttgtccaacgaacagagaagtatcttgcctataactattctccttggtggcttctaggcaaacatctacaaccgcaactccaccatcgatggaccgttttgcaaaaggcctgttgccgttttgcggagcaaccggggttttatttgtggatcatagatacgcaagagcaacgcgttggtctcatatacgagatcaattggcattataagtggggtgtttcttttcgtagacgttattttcgaaaaggagaacctatcggctgctgcccatcgctaaacaattattctagaaagtcctgtcgaacataccatcaaaggtggcagccggaagcttaccgagtctggttattacacaagttgatgcaacagcaaaaacagatcctcagtcttcaagcactcctttaccctctcggaggacatatcggcaatctgccgcattggtgctatcaacccagtgattatggttttttgttggaacatcgaattttagtcctgcgctttttatttcatcaaaatgcaaatcgaaatttttctcactggctgaatcagttgcgcaaaatgaattggaactggttgtttcctatgattgatcaagggcaactattgaaacgtatttatcaagaatgttctgatttccagaaaattcaacctttttgattctcttagctcggttcccaccaaaagtatgttaagattattttagtatgtaaaggagtgaagaatatgtcagaaacaaaacaattaccagatcgtgcggatctaccggaagcattaacatgggaccttacaaagatctatgccgatgatggggcatttgaagaagcgttccaagagatcgtggctgagttgaagcaggctgatgatttcaaagggacattatcacaaggaccagcagctttcaaggaagcattagaatatgtgttagcgatctcccgtaaactggaaaaactctatgtatacagtcatctgaaaaatgatcaagatacagccaacacaacctatcaagggctttatgcaaaagccagcaaccttgttgctcaagtaagtgaggcgattgcctggtttgatcctgaattgctttcaatggatgatgcaactatttggggttatttcgaccaagagccggaattggccatttaccgccatcttattgaaaaaactgtcaataaccgtccccatgttttgccggctgaacaagaagctttactagcaggtgcaggagaaatattcggcgcttctggaaatattttttcagtattaaacaatgccgatttagaatttccgatcgttgaagacgagaatggagagaaagttcaattatctcatggtgtttatggtcaattgatggaaaataccgaccgttccgtacgggaagctgcctttaaagggttgtatggtgtctatgagcagttccgtaatacatttgcccaaacattaagtaccaatatcaaagcccataactttaaagctaaagcacgccactatgagtctgctcgacaagctgcattaagtgccaaccacatcccggaaagtgtctatgacaccttggtagctgtcgtgaatgaacatttgccgctgctgcatcgttacatggagttaagaaaacgcttattggctgttgatactttgcatatgtatgatgtctatacaccaattctaggggaagctccgattcgctatagctatgaagaagctgtcgcaaaagccaaagatgctttaaaacctctaggtgaagaatatttagccgtggtaaacgaagcgtttgaaaatcgctggatcgatgttgtcgaaaataaaggcaaacgcagtggcgcctattcatctggcgcgtacgacacattaccctatattttgatgaactggaatgatcgtttggatcaattgttcacattggtgcatgagatgggtcacagtgttcacagttattttactcgcaacaatcaaccttatgtttatggcgattattctattttcttggcggaaattgcttcaacaactaacgagaacatcttgacagaatacatgttgcaaactgaaactgatcctcgcgtaaaagcctatgtcttgaatcattttctggatggatttaaaggaacgattttccgtcagacacaatttgctgagtttgaacactttatgcacgtagaagatgccaaaggaacgccattgactagtgaatttttgagtgacagctatggtgagctgaatgctaaatactacggtccttctgtagaaaaagatcctgagatcagtctagagtggtcacgtatcccgcatttttactacaattactatgtctatcaatacgcaacaggcttttcggcagcttctgcactagctaagaaaattttaacaggagagcctgatgccttaacgaaatatttgacctatctaaaagcaggcaacagcgattatccaattgaagtgatgaaaaaagctggagttgatatgactaaagcagattatatcaaagacgcgatgaaagtctttgaacaacggttggatgaattggaagcattagtcaaggaattagaagcataagcaagactgtcttagccactgaaggatcgttgatcgatcgtcagtggcttttttaagcaacaggttgattgccttattttgacggtgacgcctagaaaaaaagtaagtataggaaggatttgcttgtcaacagaaacctcaatttaaactttaaagtgagaaaatctttttttatgagtaagcaaattgcaagaagcaaaagtatttccatgttacgatagaaatgaaagaggaaagggggcctttggaatggacaaggaagaaatttttgcccgtcgcttggataatagcaagaaaaaacgggaagttgtcacgaaagaagctgtatctgcccacaaagagaagcagaccgaattagagcagaccgaattgccggatcaagaccctacagataaaaaagatccttcaaagaaaaattctgataggactgaatagaaaaaacatccaaacggtggatccaccctttgacggtctcttattaataggagaccaccaaaacgagggtgactcgatcagcgtttggatgttttattgattgtttaaagcaagacaagtcgtcgattcaacgagtcgatacgaggaacatcagcatccctgatatctttcttttgatagaataaacgatagttttcctgatctgttcggcaaaggtgtggaatatttctaagagcttccattccttctaataagacaccataatctcgttcacaaccgaaattatacactacagccgaaggagacatcgtaatgcccatttcgcgagcaacactttggtcggatgcgaaattctgcttgatcaaatcagacttgcgatcttctaaaaacatgtcaagatcgccgtttgtttcagcgaaaatctgtttgactaattcgaaggaataaggttctttatttacgcctacttgacattgaagtttaagtaaaaagtcgcgggcgatttttcgaccttgaagctgagctgctttgtagtccaatgaagcctgatagatttgactggtttgttgattacgcaatcctagatcggatcgatccattgaaaggtaatccattgaaatccccacagtgtgtaaattcatgattggtaatatatgcaattgtattttttttctttgatcactcagtgcgtccaacaaggtcaactcggattgataacaaattggacctatcggattcacaaacaaataaatctcgatcatctgaatctctccccaattaagattctttttcttttgtatatattaaatataacagaaattattataaatgagaaatgcctaatgagaactattcatactctttttttgacaacttctcttctaaggcacgaataattttattttttgctggacgataactgatatgcaggcgatcaagcaaagacaaaaatgctcgttttcctgaagaagcctctgagacttccagttcgagctcatagtcatgggattggccataccagctttcatctaaagcaagtaaaccttctgttacgctgaattctgctcgacgagtcgtcaactcagcaaaaggtttcacagctgccggatcaatttgctcttggatcaagcgatcggcaaccgcaccggtaaataagattctttgattctcacgcaaatcagctgcttcatctaacgaaaggatatcggtcgtttccaataacccttctttaagaggtgatttaagcgttaattctgctttatcttccgtcgtccgaatccgcaaaccaaactttttttgttttaattgatgatccaatgtatcaaaataaagatttgtttgggtatgaaaggcggagcgatcaagctgatagaaggcaaagactctctgatattcttcacgagtcaacaatgttttaaattcgatttctacttgatgtgtcattgttttcctctttccttacagtccatcaagtttacataacgacgggcaatatgtcaaatgaaaacccttggaagagttgaagcaaaaaagagctctgttatttttcttgcaggtggcaccgattgaacattctgttttcctttaagattgtggtaaaatagaaccgtatgttatgaaaagaatcgagggatagaaatgattcgagattgggaagattttttggcaccatatgaacaagccgtctcagaactaaaagtaaagttgcggggaatccgcaaacaatatcgagaacaaaataaacacgtgccgatcgaatttgtcacgggtcgtgtaaaaccagtcgatagtattttaactaaaagcaaattgcggggaatccctttggatcgtttagaagaagaaatgtcagatattgccggcttgaggatcatgtgtcagtttgttgaagacatccatcaagtagttgatcttttgcgcacccgacatgatatgaaggtaattattgaaagagattatattacaaataaaaaagcgagcggttatcgttcctatcatttagtgatcgagtatcctgtccaattgatcgatggtgaaaagatcattttagcagagatccagattcgtacattagcgatgaacttctgggcaacgatcgagcattcactgaattataaatatcaaggagaatttccagatgaaatcagcgagcgcctgcgtcggtctgcagaagctgcctaccaattagatgaggagatgtcgaatattcgcgaagaaatccaagaagcgcaacggctgttttcacatgggaaaggcaatcataaggaacagcggcagggggatgaagtatgacagggatcaaagtagcaattatcaacaatcaagaagaaaagtcgatgcttgtcacaaagcgattaacagaattgttggcccagtctgacaatacgattgaccaagagaacccagaattggttatttcagtgggcggagacgggacactgttgtctgcgtttcacttgttcagtcatcgcttagcagaggttcgttttttgggggtccatacaggacatcttgggttttataccgactggcgagactatgaattggaagaattggtcgatacgttgtgcaatgatcgtcaaaagagtgtgagctatcctttgcttgatgtccgcatcacttataccaatgggaaatcagacaaacattttcttgcattgaatgaatcaacgatcaagcggggaaatcggacaatggtagctgatatttcaatcaaagaagatctttttgagaaatttcgtggagatggcttatcgatttcgacacctacaggctcaacagcttacaacaaaagcgtgggaggggcagtattgcatccaagtatcaatgcttttcaactagcagaaatcgcttctttaaacaatcgtgttttccgaacgttagggtcaccgatcattgtcggagatcatgagtgggtcaaagtcaaactacaagctagtacggactatctagtgaccattgatcaatttacgattgaacaggaagaaatcgatgcgatttattatcgtattgcagacgaacggatccactttgcctcctatcggcatatgcacttttggaaccgtgtcaaagatgcgtttattggagaaatttaacagttatggaatttacttatcattatgagcggcaagagccgcaacagttaaaatactttttgaaagagcaagggatttctaaaggattgttggcaaaaatcaagtttcaaggaggcaagatttttgttaatgaccaaagacaaaatgtcttgtattctttggtgcaaaatgatacggtaaccattgtgatcccagacgaaggtgaacatgaaacggtcttattagatgagacgccaatcgagatcgtttatgaagaccagcatcttttgattgtaaacaaaccagcaggcattgcctcgatcccggctcaatatcatcctaatgggacgatggctaatcgtgtcaaagcttattataaacagcaaggttatcaagatcaggtcattcatgtggtcactcgcttagatcgggatacatctggattgatgttgtttgccaagcatggctttgcccatgcgaagttagatgttcagctgcggcaaaagcaattgataaaaaaatatcaagcaatcgttgcgggacagattcaagaattggcttctcacggagaaatcacttatccgattgcacgagatctcagttcattattaaaacgaaaaacaagtttggaagggaaatccgcacgtacggaatattggttgacgaaaaaggatcagcaagttgctgtggttacgattcttcttcataccggtcgtacccatcagattcgcgttcattttgctgccatccattgtccattactgggagatgaactttatggcggtgcgatggatcttggcattgatcgtcaggcccttcattgttgcgaattggcttttacccatcctttcagcggcaaatcgctgcattttaaagcagacttgccggcagatatggcatcaatcaaacaagcaatgagtgaataaaagaggtgaagagattggatgaaaatcaagaacttaatgagcgctttgagcagctgactcaggcgttgaatgaaacagatatccaaaaatttcgtgaagtgtttttggatctgcatatttatgagcagggacaattctaccaatctctcgatgagtcgcagcgccaaatcgtttatacgtacctttcacccaaagagttggcggatatgtttgacgtgatcgaagaagatgatgaacatatgacagagtatctttcggaaatgcgtcccggctatgcggctgacatgctagcagagatgtataccgacaatgccgtcgatcttctgaatacgttagataagaagcaagtagcaaaatatttgagtttgatgccggcagaagatgctagtgaaatcaaagagctcctgcattatgaagatgagacagctggttcattgatgacgacagagtttgtttcgatcgtggccaatcaaacggtacgatccgcaatgtatgtcctaaaaaatgcagcagatgtcgccgaaacgatttactatatttatgtcgtcgatacggacaacaaactggtcggagtaatctctttgcgggatttgatcatcaatgatgaggatacgatgattgcagatattttgaatgaacgggtcatgtccgtgcatgtgggggatgatcaggaagatgtagctcagacatttcgggattatgactttctagctttgccagttacagattacgatgaccatttattagggatcgtaactgtcgatgacatcattgacgtaatcgatgatgaagctgccagtgactattccggattagccggggtcaacgtggaagaagtcagtgaaaatcccctcaaagcctcttcacgacgcttgccatggctgatcacattgcttttcttggggatggcaacagcaagcttgatcagtcattatgaagagcttgtaagtgaagcaagtattttagccgtttttatttcattgatcactggtacagcaggaaatgccggtacgcaatctttagcggttgcggtccgccgtttggccatctcagatgataaagaaaaaagctttatgcgaacggtgatcggtgaagtcctcacagggttagtgactggtgctgtcaccggtttaacgatttttgcgatcgtggctgtctggaaacaaaacccgatcttaggttttgttattggaatggcgatgttgtgtgccattacggtagcgaatctcgcaggaagtctgattccaatgttaatggataaattaggctttgatccagccgttgccagtggtccattcattacgacacttagtgatttgactagtgtcttgatttatttcaacattgctagcttatttatgaactattttattcgttgaaaaaactaggtattcctttcaatcaaagtagatccattcatcaaaagcgaggcgcctcttttctataagagacgcctcgcttttttgtcttattcgtatcgatgatgggaccatgatggtaaatttatttttgcaacttgggaataactgacgaaggagaaacgccaaaaagttttttaaaagacttgctaaagtgatacgcgtcttgataaccaacagcagaagcgacttctttgatcgtgagtttctcgtttgtcagcatatctctcgcacgttttagccggatctcgattaaataattgattgggctgactccagtagcctctttaaaaacttttgaaagataggttggactgagaaactgatcttgtgcgagcttttctaaagtgatttcttctttatagtggttctctaaaaagtagatggtgtagttaacgatttgttggtggcggcgttggcttttcgtgagatagggaaccacattcaaacgtttgtcgtttaagcctcttaatatatagaccagcatctcgatgatcaatgctttttgcattaattggaattcatcttgctcctcattactctcccgaacgagctgccacgctttatctaaaacttggtggtggtattttcctaaatccagtaacggttgcttgttggggaaaaagttgcgtttgaatccttctaaagaaatattctttaagccaatatgcagttggtgggaacaagtccctgactcctgaaactcacaatgattgacaccagggttaaacaacatgatactgcctgccttgattttagtagctggcgcctcttcaaaataataattgctttctccttccaaaacgatactgatttccaagaaatcatggtgatgcatttctccatgactttcagactgtgtccaaggatcaaacaagtagataatttcgggattaaaggttctgggatttactagattcattcatttatcactccaatggtgtcagaacctggtaatttcaggtcgacggcttcttagtaatattttacatcaaaatgagtaagaaaaaccattttaatcgcctagtaaatcgctaagcttaacaacgagagggggaattagatgagtaacacacaatggatctggcgatatgcgaaaaaaaatcgtggccgaatcattttagcaatcctgtttttacttattaatgctgcgttgatcgtcgtcaatccatatctagggggaatggtgatcgatgatgtgatcaatcagcagcaaacgcacttattgattccattattactgattatgatcgcaacgacagtgatccgaaccattgtccgctatgcgtatcaactattatttgaacgagttggacaaaacacgctctatcatttacgagaagatttgtatcacaaactgcaagaactggattttgacttctttaatcatacgcgagttggggatattatggcgcgtatgacaggggataccgatgctattcgacactttgtttcttgggtgacctataatatagccgaatgttttttgtggtttttctcagccgtagtggtcatgagttttattgactggaaattgatgcttgctttagtcgctgtgacgccaatcatctttctattaacgaatcaaatgtcaaaaaaagctcatccattgttctttgagattcgggaaagcttttctcggttgaattcgatggtagaagaaaatattggtggtaatcgcgtcgtcaaagcatttgccagagaaaattatgagatcgacaagtttaaagcgtacaaccaagatttcaagacccgcaacatggcttctgccgaagtatcccgaacctatttgccttggttggatggattagccggaagtttgaatgtcattgctttggtcttaggaggaatctttgtgatcaatggagacatgacattaggtgatctagtggcattcaacgggtacctatggatgttgaataacccgatgcgaatgagtggctggctgatcaatgatgttcaacgtttttctgccgcctgtatcaagattcgtcaaatgctcgcacaagagtcgaaaattcctgtccatgaaaagaaagccttggaaccaatcaaaggctttgtggaatttaaacatgtttcctttcatttttccgatgatccggatcaaaatgttttggaagatgttagctttaaaatcggacctgggcaaacgttagggattttaggtgaaaccggctctggtaaaacaacattggtcaatcttgtaggccggttttatgatcctactgagggtgaagtgctgattgatggcaaaaatgcgaaagaatatccggtccgccaaatgcgggagaacatttcaatggtcatgcaagatgtattcttgttttctaacacgatctctgacaatatcgcttttggaaatccgttggcagacgaaaactttatccggcaaatggcggtggtagcggatgccgacacctttatttcccgaatgcctcaaggttatgaaactatcgtcggtgagcggggagtaggcttatccggtggccaaaaacaacgtatttcattggcacgggctttggcgaaagatccatcgatcttgattcttgatgataccacttcagcggttgacatggagacagaatccaagatccaacaagagctaaccaaactaactggagaaaaaacgactttcatcattgctcatcggatctcttctgtccgtgaagcagatcaaattctgatgatggaaaaaggacgcgtgatcgagcagggaacccacgaagaactagttgccaaaaaaggcagatacttcgaggtataccaaaaacaattgggattgactggaggtgacgacaatggcgcgcaataaatttgatgtggatgaagaactggaacaggagttcagttggaaagactttaaacgattggcccgctatgtcgtcccttataaagcgagtatcggtaaagttctctttacgatcatcttagccaatttggcgggaatgcttgctccggtatttacaaaaattgcgatcgattcagctattcctgaccagaataaaatgcagctgtttttgatcggtgctgcgtttgttgtgacactgctgatcattggactgtgcatgcgttaccggatttatcatattacgaatattggccaagacgtcttgaaagacatgcgttacgatatctttgaacatttacagcgcttgcctttttcctattttgatacgcggcctcatggaaagattttgatccgtgtggtcaactatatcaatacactgagcgatctattaagcaatggactgatcaatctgatctccgatgttttcaatgtagtgatcacactgattttcatgttagtcatcgacgtcaaactgacattgtattcattggcactcttaccgatcttgttcgtgatggtcatggtgattaaaaataaacagcgcaaagcttatcaagttttaagcaacaaacagtcgaatctaaatgcgtatattcacgaaagtatcgctggtatcaagatcactcaatccttcgcccgtgaagaagaaaatgcccaaatttttgaagaagtcagcaatgattaccgtacatcttggatgaaagctgtcagagtccaatttttgatgtggccaggggtgcaaaacatctctgtgatcactacttgtctgatttactttgttggtattcgtcaaatcggtgttgatgtcagtactggcacgttgattgcttttattagttacatcaataatttttggaatccagtaatcaatatcggaaatttttataattcactgatcacggcaacggcgtaccttgaacggatctttgagacgatggatgaagtaccggatattgaagataaagctgatgcgatagaattgccgagcatcaaaggggaagtggctttcgatcatgtgactttccgttacgaagaaggcaaaaatatcttgtctgatgttaacttccagattcaggcaggagaaagtattgcgttagttggtcctaccggcgcaggtaaaacgacgatcatcaacttgttgagtcggttttatgatgtgaatgaaggcagtgtcaaagttgacggttatgacgttcgggatgtgaccttggaatcattgcgctcacaaatgggtgtcatgctgcaggatacttttattttctcggggacgatcatggaaaatattcgttatggaaatctggcagcaaccgaagaagaaatcatcgaagctgcaaaaatcgttcgagcccacgagtttatcaaggagttgaaagatggttaccacacagttgttgaagagcgaggaagtacgttatccgcagggcaacgccagttaatttcctttgcccgagcattactggcagatccaaagatattgattctagacgaagcaacttcaagtattgatacaaagactgaagagctgctgcaagaagggcttttaaaacttctggaaggcaggacgtccttcattattgcccatcgcctgtcaacgatcaaaaattccgaccgtattttttatgtcgctgggggaaaaattgctgaatcgggcaatcacgaccagctgatggccttaaaagggctctatcatcacttgtaccaatcacagtacgatttgttgcaggcgatatgataaatggtagtaggctttgcgcaaaaaaagacattcgtttatcagcgaatgtcttttttgcttaatgatctgtcaaatcaacgattttcgttccgtggagttcagagacaccaagctgatcggcaattgactgggcattcttgtatgaaatacctgcacctggtaaaataatcaagcggtctcctgcatagtcgatcaatgcttttaaccgttctaagttctcttcgatagctgttcctgctggcccgccatgtgtgaggatgcggtggacgccgtgatcagcaagccaatcaatggcttcaaattggcgagattccggaatggcatcaaatgccatgtgaaaagtgatctgtaatccttcagctgtatcaatcagaagttccagtgcttcctcatcgagccagccgttcggtgtcagacagccaaagaccacaccatcagttcctaatttcttggcttcgatcaaatcggtgtgcatgatttttaactcgatgtcattataaacaaaatcaccgcctcttggtcgaatcattgtcatgatcggtacacttttttcaccagcgtaactcagtgcttcttcaatcacacccgtgctaggtgtggtcccgccgacagccaaattgtcgcataactcgatccgttttgctcctcggccgatcgctaatgggatcttcgtataattttcggcacaaaattcttttaacatctgtttccctccgtttttcagctgttattctatactagcattttaccataagtctatgctaaagtaagaaagagaagagggatttgatatgttaaaaaaaatcgatcgtgggcgactttttcttgaggcccatagcgacttatttgagtgtccattgtgtcatcagcaggtctttgccaatgagagtggactgatttgtctgaatcgtcatcgttttgatctttcaaaaaagggtactttattttttttggatcatcctgtgaaaacggagtatgatcaaggaatgtttgttcctcgaagtcggatgatccaaagtgggatgtatcgtccagtcttagagggcatctcccaccagattgaacaatccgaaaacattttagatattggttgtggggaaggcagctttcttgcccaattattagccggacaagaaaaaacggcagtaggatttgacattgccaaggaaggcatctatttggcaaccaatcatgctgcttctgccttttggtgtgtcgcagatctcacgaatcttccttttgcccccgctagttttgatacgattttgaatttattttcgccttccaattatcaggaattcgaccgcatcttgaagccgggcggacaagtgatcaaagttgtgccagcagcaagctaccttaaagagctgcggcaagctttttatccagatgattctgcaaaacaagtctattctaatgaacgtgtcgttgataaattttttgcaaaatatccgcaagcgagccgagaacggatttgttatccattctcaatcccagaagaccggcgactggacttgttggcgatgtcgccattggagtggggtgcgtcaaaggagcaaatagcaaaagttcgggaaaacccgttacacgaaataacagtcgatattgagttgttagtcgcgaaagtttcttgaaaaatttttgaacttttttgttatttacccttgcaatcatgtcatgggagtgatatattgttcttaagtcatttttcattggtttttatcaggttcctgttctgataaaagttagtgaaaagagcttcactaacgtaacgactcgcagtgattgacaccgagttggtacgtttttttttatgctcaaagtttcagtaaatcagatagaagttcgcaaaacgattttcgttaaaatatggtactatagaatctattgagagacagttggctcgaaccaattgaaaggagtcttaccagatgaatcacattgttttatttgaaccacaaattcctgccaataccggcaatatcgctcggacttgcgcggccaccaatacacatttacacctaattgaaccattaggcttttcaacagatgataagcatttgaagcgtgctggacttgattactggcatgatgttcatattacttatcacaaagatttagcggcatttatgtcctttttaggtgatcgtccactgtacctgatctctaagtttgccaatcgtgtctattctgaagtagattatacgactcatgaagaccaatttttcctttttgggaaggaaacaactggattgcctgaaacattcatgcgcgaacatgcggacaaatgtttacgaattccaatgaatgatgcccatgtccgatcattgaatttatctaacactgccgcgttgattatttatgaagctttacggcaacaagggtttccagagctagaattgactcatcactacgacaatgacaaattagattagatacaatcgataggagagacttgttcgatgcaattatattttactcgtcatggcaaaacagaatggaatcaagcacgacgatttcaaggaatgatgggcgattcaccattgttgcctgaaagttataaggagatccagcttttgggagacgcaatcgcaaatgttccttttgaaaaaatctattcaagtacctcgttacgtgcccgtacaaccgcacaagggatagtggaaagattaaagcaaccagtcgagattgtttatacagaaggattacgtgaacttggactaggcgatttagaagggcagttcattgatgaaatgcaggcaaaatacccgcaagagctggctgatttgcgccaccatcttgaccgttatgacccaacgatatttcaaggagagcccatcgaagatgccctgaagcgcattgaaacagtggtgatgactgctgtgcaagcccacaatggtccgttactttttgtcggtcatggggcctcattgacggcagctatccaatggttggccggaaaagaattggcacaattgcgggaacaaggtggtcttgttaataatagcttgaccattttagagacaggagcagataaacaattgccttttgagatgacctgttggaatgatgcaagttttctagaaaatcaagacagtttagatgccttactataggtgaaaggagcggcgtcgtgaatccagaaagaacattttttgtcggccatgttgccgcgatcttttttcaaaatcctagcaatttctataaggtacttttagtcaaagtgacagaaaataatgcggattacaaagaatctgagatcgtcgtcactgggagctttggtgagatccaagaagaggagagttaccgattctacggtgagttagtcaatcatcctaaatatggcgtccaattaaaagtggacagctatcagcaagaacaacctacatcagagcaaggtctgatcaattatctttcaggagagaagtttcctggtatcggtaagaagacggctgaaaaaattgtggggcttctaggagatcaggcgatcgatcgcatgttagaggacccggtattgttggagcaaattcctggattgaatgaaagcaagcgaaaaatgattcttgatacggttcgactcaatcatgggatggatcaagtgatcgttgggttaagccgctatggatttggtagtcagctttcttttgccatttaccaagcatacaaaaatgaagcattagagatcatccaagaaaatccttatcaattagtcgaagatattgaagggattggcttcaaacgggcagataacatcgccgatcaattaggaattgaagccacctcgccccagcgctatcgtgcggcagttttgcaccagatttttgcccaatctttacagactgggaacacgtatattcacgcacaagatttgcttgagcaaacacttcggttgttggaaacgagtcgacccatcgaaattccaccggatgacttggcaaatacgattattggattggtagaagaaggcaagatccaacaagaagaaacgaagttgtatgaaaacagtctctatttttcagagtgggggatcgccaattcgatccaacgattattagctcgcaaaaaagaaatcaactaccccaaaaaaacagttgaaaaaacactgcgaaaaatcgagaagcgattagggatcgtctatggatcttcccaagaagaagccatcaaagaagccatccattccccattatttattttgactggcggacctggaacagggaaaacgacagtaatcaatgggatcgttcaattatttgctgaattgaatgatcttgatttagatcccgcaaaatacacggaagaaatgttccccatcttgttggcagctcctacaggtagggcagccaaacggatgaatgagacgacgggacttcccagtgggacgattcatcgtttgcttgggcttaacggccgtgagaagacgcctagtgtcgctgcgaaagaacttgaaggcggtttgttgattgttgatgaaatgtcgatggtggatacgtggttggctaatacattgttcaaatcgatccctacaaatatgcaagttatttttgttggcgacaaagaccaactgccttcagtaggaccgggacaagtgctgcatgatcttttagaaatcgaacagattccaaaacaagaattgaccgagatctatcgtcaaggagatgggtcaagcatcattccattggctcatgcgataaaaaatgggcaactgcctgcagactttacccaaaatcaaagagatcgctctttctttgcttgtgatgcttacaaaattgaaccgttgatcgcacaaatcgtgcaacgggcgaaagcgaaaggcttcacaccgcaagacattcaagttctagcgccaatgtaccgcggagcagcagggatcgatgcactaaacaagatgatgcaggaaatctttaatccaaacgatgggaccaaaaaagaagtcacttggaatgaaacagtctaccggatcggagataaagttttgcagctggtcaattcgccagaagacaatgttttcaatggggatatgggacaaatcgtcggcattattcctgccaaacagtcagaagacaaagtggacgaattagtgatccaattcgatgccacagaagttacctataagcgaaatgaatggaataaaatcacattatcctattgctgctcgatccataaagcgcaaggaagcgagttcaaaatggtgatcatgccgatggttcatcaataccaacgaatgctgcaacgaaatttactctatacggcagtgacccgcagcaaagagctgttgattttattaggagaaccccaagcttatcaaacatgtgtgacacatgagtccgccactcgactgactaccttgcaagagcggatcaacggcagcgacgagatgacacctttgcaacgtcaaaggttggcacagtttgaagaagcagatgatcctttctcagagtctaactcacagacaacagccacaatgaaaagtgaaaagaaaacagatactgcccgtgagccggtgagcagtaagcagtcggttcagaaacaggaacttgatttgtttgccacaacaccgagtgaatccatcatcgaagaaacactaccggaaggaactatctcaaaagaaccgctttcgagagaattgacaatcgaaatggttcaaaaaaatgtggttgatccaatgattgggatggaaaatctttctccatatgattttctcgtctcttaaaaaagaattttttacagttaatgaaaatgagcgctttcttttggttttttagcgaaacatgctaagctaataccaaaaggaggcgttttcaaatggcgaaagaaacagatgacaaattagaaaaattagcaaaagaatccagcaataacttcaagaaattggatgagttggagaaagaatacaaacttgatgaaagtccagatgccgaaaacgagcaaggagaggaaaccgagttagagaaaaaattagacaaagttccgccagtttgggcaccaaacacaaatccgactaacccaaccaatccgaatagttcaggaagcatttaaggctgaaatcaaaaaaacgcgtaagaggagattgcctcttacgtgttttttattgtaaatgctggtaataataaatggctaactgggtacgatcccgaagttctaatttttctaataacttactgatataattgcggaccgttccttcgctgagaaacaacgcttgcgcaatttctttattgttttttccagtggcaatttccttcaagatcattttttctcgttctgagaaatgagtagtcaaataagagtcattattttttaacagtgtaggaaatttcgtgacgatttcagcgccaaacactgcttggccattgtatgcagctttgatagagggtacaatagccgaaagattttgcttgatgagatagcctttgactccgagatccaaagcttctcgtatataggcatcatcatcaaaagtagttaagagtaaaatgacggcattcggatcccgggttaaaatcttgcgagcagcatctaatccagtcccatcgggcatccgaatatctgttagtataatcgcaggttttctttcttcgtacaatgcaactgcttctttggcacaatgaccaatgcctgttacctcaatttcgtttgaaacttccaagatggtttttaatgatgcggtaactaggggatcgtcatcgatgattactacttggatcattggtcctcctccttaggtaaaataatcgtaagttgaaataaattctctttttcaagggcatggagttgtccgtttacctggttgattcgctggcgcatcgtctgaaaaccgatcccgtgggtgtgattgagcctatcctttggtttgtcattcttgatttgtaatcgatgaaaagcaggtagttgtttaaaatcgcaagtcacttttgttgcttgactgtgcttcatgacgttggtcaaggcttcttttatgatcgtgattaggacagtttgttgtgtttgagagagaatacttggcggtgttcctattacctcaactgtacaaaattgaaagtctgatagcaaaagatctaatgcttgtggaaaaagaagcgagtgatgatgtaaatcgtgaacactttctcggatgcggtccatacccaagttcatggttcggttcaattgatccaatggtaagtgaagttgcttattttgattaattgcttgaatggcacctaattgtaagatggcacttgaaagcagatgaccaacattatcatggatatcacgagcgattcgattccgctcttcagcgatctgtaaggcgacttctgtttcttgagagcttttaaggtagtcgttttgctcacgcaatcggctctcattttcccaattggcatcttgagtcgagttgaattttttttgtaacgaatgaaattcaaaactatcgtttcgcaagtaagaagcagagtagaccaaaagcatcagtataatccgtatcggccaagaaggaaccaaggaaaataagagtatacaaagaatgagcaggaggatcttttcttgcttttcaccaatctgggctgaacgaaagacgcatgggaaaaaatagctataaattggccaaaccaaactaagacctatcaaaatgcccaatgccagccacgttccttttttgaatagcagacagagaccacttaagatgattgttgtcaaaagatagattaagtctagggcttggaagccattcagggacattagccctccacagagaagaaaataaaaaacaacctcattaatcgacaatggtttattcatatctggctcctaaataatgacaaatgtcatttttgttttggcgtatcctcactagttattcttttcgctttttattatagtcagaataagaagtgtttggaaaggagttttttcgatgattattgaaattgataacttggtaaaacgttatggtgattttctcgcattgaatcattttaatttgcaagtcagggaaggtgaagttctcgggcttttaggacctaatggaagcggcaaatcaacagctatcaactgtatgttgtccttattatcttttgataaagggactattaaattgtttggggaaaaaatgtcaccgacaagttatgaaataaagcaaaaaattggcgtcgttccgcaagatatcgctgtatttgaagagttgactgtctacgacaatgttgattacttctgtggtctgtatgttgctgacaagaagaagcggaaactattgatcgaggaagtcatttcgcttgtgggattagaagagttcaaaggattctatccaaaacaattaagtggtggcttgaaacggcgtttaaacattgcttgcggcattgcccataaaccacaactgatttttcttgatgaaccaactgttgccgtggatccccaaagtcggaacaaaattttggacagtatcaaaaagttgaatcagcaaggtgcaacaattgtttatacgactcattatatggaggaagtcgaaatactttgtgatcagattgtgatcatggatcagggacaagtcatcgcgaaaggaacaaaagaagagttgaaggacatggttcgaagtacggaaaatcttgtgattgatatccctttacttccagatacagcgatcgaatttatcaagtcattgcctcaagttcttgaaactgcctatgataaagagcgtttgacgatcacagccaaaaagatgaaagagattcttttaccagtactaagctatttggaggatgaacatatcgcatttactaagattcacacaggagaagcaacattaaacgatgtgtttctggaaattaccggtaaagaattaagagactaggagggagattatgtttggacacttatatcggtatcgcttgaacgttttagttcgtaataattccttactattttggacattgatcttcccgattttattagggttgatgttttctgtagcatttagcgagattgatcaagctggaacgatcgagacgattcccgttgggattatcaaagaagaacaaaatcagaaaacaaatgagggacaactgactcagcaagacgcatttatgaatgttttgaagcaaacaaaatctggtggagaaccattgttttcactacaagaagtctctcctcaagaggctgaaaaacgattagatgcaggggatcttgctggatattattcctttgaacagtcatcgatccaattggctattgcacgtaccggtctttctcaaaccattctaaaaaacatgatggaccgatttttacaaaatactgacctggccaataagttggtggcaattgactctactttgacagaagaccagctcacatcttttctagttggagaatcttttgttcagcaagaaaatcagactagaaacatgagtatcaaaagtttttatttctttaccttggtgggaatggctattttgtatggattcatgtggggggtcagaaacgcccaagaccagcaagcaaatcagtcttccaaagggattcgcctttcgatcatccctcgaaaccggttgctggttttttcagcaaatatccttgctggattcacgatatttttcttagaagttttagtgattctaagtgtttttcattttatttatcaagtcgacttcggaaaccgctggcagtggttattcgtcctatccgctttgggtgcattgaatgcattattattagggaatttggttgggaatttgcttcctaatatggggctggcacaaaaagaaggattgggtgtggctgttacaatggcgatgagtttttttgctggtatgatgggctcccaagacatcaaatactggatcgatctgcacattccggtgctaggaaaactgaatcttgtcaacttaattagtgagagtttctatcagctctatttttatcgctcactagaggatttctatttgaatcttttctggttagtagcctttatggttatcttagcctttagtaatctaatgtttgaaaggagggttcaatatgtcgctgtataaagccgttttgaaaattttaaaagcgaacaaaacaaatttgttgattgcagtcattgtaactgtgatcatcaccttcttctatgcgcaaaatacagcagcaccggatgcaaaattggatcgggggacaatgaccattgttacagaagacaactccgcattaagtaaagcactgattgactatttaaaagaagaacaaacggttgtggaattgtctgataagagccaaaaatcgattgatgatgcgctgtattttggaaaaatcgactatgttttatttttgcctaaagattttactacgaatattgaagcaggtgtaccgtcagcaatcgatgcacaatctcgtcccgatgcttttgctaaaacattgattgaagggcaagtagatacctttttgtcgacttatacggctttttatcatgtaactggcaatagggaagaggcattgaaaaatacgcaatctactttggccgcaaatggcgaagtaacgattagtcgtggatacagtgaacggatgaaccagcaattcggcagcttagtattcaatgcacttgcttacggtttgtttctttctatttttagtggctatggcgtggtcaatctagtgttcaatcggaaagaaatccggaatcgcaatcaagtatctcctttatcaacacggcggttgaaccgagccgtttctattggtatgttggggtattcactgcttctgactagttgttttacagcgggattactcctatttactcgtagcacgtggtccgtcatgaccggctatctagtgattaatcttttgtgttttttcttgccgattgtcacattttcaacgtgtattacgtcatttgtcaaaaatagtgaggcgttgaatggaatttcgaatgtgtatattatgggaagctgttttttagggggagtttttgtttcatcagattttttaccagactttattagtaagatcgcttcttttacaccgacttattggtttgtacaaaacaatcaattgattgggaacaccctctctgtgaatgcggatttcattacgaaattctggttgaactgcttgatattggtcttatttgcctgtgcctttttgataatacagttcgttttgaaaaaagacagccgctggtttaatcaaaaaagggttgcatgagtcataaaaaaatgatgccgctgactcaacagctgcatcatttttctaatctcactatttctaactccatatcaattgtttggtagtggttatggtgatatcaaatggccgcttacccatttcttcgccgtcttcttgaccatgctgtggtactgtggagacgattcggagcttattcgtagataaatgatggaagtagcgagatctcatttgtttcttgcgggttagtaaggctaaaagccaaaaaattttgaacaaagcgactcgctcaacgagaacgaaatcgatcttatcttcgttgaggtttgctgtaggtgcgatcgccacaccgccaccgaagtaggggtgatttgtcgttgtgcacaagaaagcctttgtaaaattcaattgtttcccattggtttctaccaggatgggaaatcctttttgccggaataagacattcactactgcagacaagtaggcaaatgaacctaaattgaacttgtttaagtttgatttcgcagcagaatgatttgctgcgtaaacgatcgatgcatctaatccaataccgatattgttgattgcgaacccagtttcatcttggatttgatcatgatacttgatgatcgtaaccgattgaggagtagcggtcccagcgattttccaaaatacttgctctggttccttaggtaaacgcattcctctggcaaagtcattccctgatcctgccggaatgtagcctagtggaatatttttttctgattcttgaagggaggaaactacttgatgtaaggtgccatcgccaccgatcaccaccagtaaggggtaaagcatttctgaattttctcgatagatgtcatcccatggcaacaatacttgtgccagtaaagaagtagtaagttcctgttcttgcccggcatattctgtatagtagaactgatggggaaaacgccgcttcttgacgattgcttcaatttttttggctacttttaggccacgtccactgcctgcttcagggttaacaacaaaatgataataatatttcatacaataaatgctccatctaatctaaaatcaatgctgtttattatagcacgattgctgacaagtttggctagtgatgcttaactattttttgacaaaaaaatagattcgacgaaaggtacgtaacaacaagctactattttcgctgttgtttttgtgatctaaggttcttatgtccactatgatcacatccgtattgctcacattcgccgaatcctattcaattagtaaggagtaactcaaattcccacatcctttgtctgtttttctaagttgacaacaattcttttcttgcagatccttcatcgtctgctttactgggaatccttgctccttacacttatagtatagcacgaaaacggatagaagcaaccgcttacatggtctttgtcactatctttagataaatttaaagatatcaaaagacagcactcttgaacttattagccattaagtcgatgaacaatgaaggtgtacgattcccctcataagcaaacaggaacttagaggaaaatgaacaattgaacgattcacagacatcaagtttacatgaagttggtttgacgaataaagagacggatgtccgtctctttgagttctttatccaagtttattcaatatagctgatggaacatcattaggcgagacttcttcccatcccattactcctttatgattatttacatgtaatacaaggtatgcattctcttttagtggcttgtctccataggaattaaaagacacatctttttcattattgtctgatgtatagctagctaagttgtactgtatctaaagtgttctctcccgctacctctaccaatcgaaacgcgttcacctttcgaagttatcttagtgtagtaatctgtcgttccataagattgctcataccagaaccagcctccacccatcagaagaagggttactacagtaaaagataatagttttttcatataaaatcattcctttcgaggaatagattacatctatgaataatgaaataaatcaatctaaaggctgagaataagcaaacaaaattgtaaggaggacaatgagaattagtaggagaggaagaacagaatgaattgcgagcaaataaatactcaatgctcgtctttggcctattttgctggaagattcctattcaaagcagaaccaccgttttaatggttatgtatttaaaatattctagtcatttccggtatcttttttagcctcgctgatagatagatcgttcctctttctttttttgttgattttaacactttgctatttgacaagtgggttgctttagaaggagattgtacgaccttgttactgaagaacagcttgggggaaaataggtttttagactttcatccacaaaacatccacatgaattctccaatttaattggacaatggaaatcaataagaaccaaatcaataatgtaagcttgataaatcagtaatcttctgtataataattatttgtgcgtaacgcatcgcggttcatcaaccatcccgcgtaatcaaaactcggagaaagaagggatcaaatggataaatcatccactttatcaaaccagcggttgcgagttgtcgtcgcgaacggtttgatcatggcactgtatgttgcagtgacagtcttagtcgccccagtggcttctggtgccattcaatttcgtgtctcagaagggctgaatcatctggtagtctttaacagaaaactgatgtggggtgtttttggcggagttgtattgtacaatttattttttggtatgggaattttggacgtcgtctttggtggaggccaaaccttgcttgcattgtcagcaacggcgctattgcagaagaaagttccgaatgtctttgtccgtttagcgcttaatacgattttcttctcgttgagcatgttcttgattgcaatcatgctgcatctgactctcgcattaccattttgggcgacctttggtacaacagcgctaagtgagttgattatcatgacaatcacagcgcctataatgtatatcgtgaatacaggtgttcgcttcgataagcgattttaatcaatcatttgttttttgctttgatggttcccaaaaaacaaataaaaaaagatcatctctaccaaaacctacggtagagatgatcttttttgttattctgcattcaaatcttcaatttcaacaactttgaagttttttgcctctaactgataaatgatcttatcgcacagctcttttgacgtattcgctggtaaagtaatcaatgtccgacgaataaattcatccttgccgatgtccaatgtgatacagctggcaatactgctgtatttcgcgatgatttttgaaatgatcgctaagtcaccttgtgtgccagttgatgcgatagtcagcacgtagctaccttgttcgacattccaagattgagacagcatattcaataatgaactgtgggtcaaaatcccatagaactcattgttttcatctaatacggcaatgtatggcaattctttgatcgtgaaaaagactttaaaaaatgaagaattgacataaataaattttgtcgcgtttttaagcaggtgtgtcactggtaatgtcatatctccaccattcgatttgtgacgatagatgtgcattttatagatgtttccccggaagattttgccggattcatctaagatcggtacacagcgatagccagaatcttctaaaatttccaaggcttcttctaaagtagctgtttctttaatcgtagttaagtcgcgttttttgtaaaccattgtttttagtaacataacaattccctcccaaatacccaattcacatctctataataccataaaatcagcggaaactatatttttgcgtgtcaaaatctaaaattgacactttcactgaaaaatggtatttttaactttggaaaactttgtataaagggggaggacatcagaaatggcaacaaaaaaagcagctttggcttgttctgtctgcggatcccgcaactattcgaaatcagtcagtgaaggaaaaaaaggcgatcgccttgaaattaacaaattttgcaaatactgcaatcaatacacgctacatcgtgaaacgaagtaaggaggaatcttgatgaactttatgaaaaatgtttttgctgaaatgaaaaatgtttcttggccatcaagaaagcaattacgcagagatacttttgttgtgatccaaacgacaattatttttgcagtgatgttttttgtgatggatacgctgattcaaactgtttttgatttgattttgaaataaatgctgctggattatcagcaactagtcaagtaaaacaaatcgtggtataattgattcgaggaaaaacttcggtgcaactgaggtttttttattttacaaaaagatagggagaccgaatacaatggaatcttttgaaaaaaattggtatgtcttgcatacttactccggctatgaaaacaaggtgaaagcgaacttggaatcacgggcgcaaagcatggggatgggcgattacatctttcgtgttgtcgtaccagaagaagtcgaaacggaagaaaagaatgggaaaaagaaagagatcgttcacaaaacttttccaggttatgtcctcgtcgaaatggtcatgacggatcaatcatggtatgttgttcgtaatacaccaggagtgactgggtttgtcggctctcatggagcaggaagcaaaccagctccgcttttacaagaagaaatcaactctatcttacgttcaatcggtatgagcactcgaacagttgaattggaagtggagattggtgaaacagttaaaatcattgaaggtgcattctctggattagaaggacaagtcgctgagatcgacgaagaaaaacaaaaattaaaagtcaatattgatatgtttggtcgagaaacaagtacagaattggattttgaacaagtagataaaatctaagtataaaactgtagtgttttttgtcaaaataaggtaaaataaaattgaaaattggtgatagcggaccgttattggcccgctgtttttatctcacgaaaagaaagcgttttataaaaagggggtactatgaagaaaattctcgcatcgatttgtcaacgccatttttttgatcaacatttggaaaaaagaggtgtgatttccgtacataatggttatagtttgttgtttgcttttaatttgtttttgctgctttctgccgtgatctttatggaacctcaaaaagtgtttcgtgaaatgcttacaatcatgttctcggaaagccatttagtaacggattacgttgcgctgacttctgtaggtggcgcactgttcaatgcgtcgatcatgacttttgttgcgatcgcggtctgttaccattaccgagttccggttactggaggaatgatatcagccgtcttcatggttacggggtatggtttgtttggcaaaaatctgttcaattttattccaatcttcttaggtgttcgtctctattcctatttaatgaatcaacccctcaaaaaatatcttctcattgctttgtacggttcctccgtttcacccatcgttagtttttttgcattcaatgactcacttccagcttatttcggtagcttcatcggttatttgatcggtgttttgactggattgatcatggttcctttagcactgcattttcaagcattatttaaaaaagtcagtatctatagtgccggctttacttctggcatgttgtgtacgatggttgcaggaatttgccgaatgtttggttttgatatcgaattgcgagcaatcgtttctaaaggctccaatcttccactggttattatgatggtgtcgctgtctttattaatgattggctatgggttagcaatggctgttaaacgcaagcggttgaacatgcgggcaatatggtctcatagcggcaaaatcgaatacgatattttacgtgaaagtggcgtttataatacgatgattaatatggggttaatgggattgctgttaatgagttatgtgagtatgctaggtgtcaatctcaatggtcccattgcaggtgcgatgttttgtgtcattggtttttctgcttgtggtgcccatgtctttaacgcgctgcccttatttgccggtgtgctattagcaaatacaatgaatatctacgcaatgactgaaacagtaaccgttacagcggctatttttgcaatgatgctctgtgcggtgactaatgcttacgggtggaaaggggggatgatcgtgggattcattcatacgtcgatggttttgaatatcgatgtgcttcatggtggattgaatctgtacaataatggcttttccggagggctcgttgcgatgatgatcattccattgctcgattttttttcacaaatcgcggacacctcgatttttaaacggaagaaacagtccggaggcaaagaaaaggtaacctaccaagcaacgagtaaagaatgaagtgttcttgaataaagagtaaacattagctattgcttgtttcttgtttcaaaagggattatactagacccgatttggagggactgtaaatgaaaaaatggctatttctatgtctggttgttttgcttagcggctgtcaagcagcaactcactcaaatgtttcagcacaaaaaagtacacagaagccaacggagacaacgactgcttcggcagaaacatcaaccaccgaacccgttcagaaaacgaccacgccaacactctttattcatggttatcaaggaggtcccgcatcatttggagggatgatacagcgttttgcccaaaaagattgggtgagcaatgaaatggttctaacaatttcaccagatgggacagtttcaacggaaggagtgctttctaaaaaagctgtaaatccaaccattcaggtcttgttcgctgacaatcaaaataatgaatggaatcaagcagaatggatccgacaagcgttgctttatctgaaaaaggaaggaatagagcaagtaaatttagtcggacattccatggggggagttagtggttttcgctatctcacaacatttggagagctgagtgcagctggggctgaagcactggatcccgcattgccaaaagtagctaaatttatagcgatcggggcgcctttcaatgaatttattgatacgagttcacgacagactatcactgatttagtgacaaacggaccaacggaggcttctccacgctaccaggaatttcaaggactattgaagcaaggggggcatcgactcccgattgagctgattgctgggcaattatctgatgaagagctatcggacggcactgtgccgaccacaagtgccttggcgatcaaccatttattggcagcgaatggctattctgtgactgaaaaaatcattaaaggatcacaggcacagcatagtcagctgcatgaaaatcaagaagtagatgaagacattgctgcttttttatgggagaaataactgatagtcgtcaaaaagctgtaagaataactttgatataagttctatctgtttttttagtagtagcaaatagataaaaatatccgaatgatcggagatcgcttattcttctcgtgcataagtaacgaggacctgcagagccgcgggtgctatctaatgatcattcggatatgttatttgttgagactcttacatcttttagtgttcagcggcatctaaaatttgcgcttgtagacgttgtgctgtaggcgttgtggccaacccgccctcggctgtttctttaaaaatacttggcatttgccgtcctacttggtacatcgcgtggacgacctcatccggaggaatcacactttcgattcctgctaaagccatatcagcagaaataaatgtttgtgaggaaccgagagcatttcgcttcacgcaaggaacttcgactaacccagcgacaggatcacaaatcaatcccatcatattctttagtgtaatggctactgcttgagcagcttgatgtccgctcccacccttagcacagacgagggctgctgctgccatggcactggcagaaccaacctccgcttgacaaccgccttctgctccggatatcgaagcattgttcgcaatgactagtccgaaggctccggcagtaaagaggaaatcgatttgttgagaacgagacagctgcaaacgatcgcgaacagccatcagcacaccagagacaacaccggcactcccagctgtaggagtggcacaaatcaatcccattttggcattgacttcattgacagcaatggcattttgaacggcttgcaagatcgtctcaccacttagaaaatcaccagcctgtatataatcattcattcgtgtggcatcgccaccggttaatcccgtcacagaggtcactccagcaacgccctcggcaacggattgttccatgaccgtcaggtttttgtccattagtgcaatgacttgctcgcgagtgcgccctgagttttcgcattcgaccgcaatcatcatctctgcaatcgatgcataatttttgctttgaagaacaagatcttcaatcgtataaaacatgacgaatcctcctttaatcgaaataagccgcactataaacgtggggcagtgctttgatttgttgtgccaattgatcatttcgttcatccacttcaatgatcataatggctttttctcctttggactctcgggtaacagtcatcgtaccaatattgatttgtgcctcagaaagtagattcgtgacacgtgcgaccattccgggaacatcttgatgaacgatgacataggtaggggtacctaaagtcaatgagattttaaaaccattcaattcagaaatttgtatattcccaccgccgattgaaatgccggtaacggacattttgcggtcacctttttttaaaatcattttgaccatattcggatgttcggctttttcgtttttcggaacaaagagtacttctagaccttgctcataggctaactttaatgagtcagcaaggcgctgatcatcgggctccattcctaacaaaccgccgacaagtgcaatatctgttccgtggccgcgataagttttcgcgaaggactcatacaaaaggatatcgacactgtcaggctgttcgccaaagatgtggcgcacgattttgccaattcgagcagcacctgcggtatgggaactgctgggtccaaccataattggtccaataatatcaaagacacttcggtattttaaaggttccattctattcacctcatttaattgatgggagaaatccagatgtagtttagcataaaatatggagaaatagagcaatgagtggaactgtatgggatttttttaatcttttttttgttttaccgattttctccataaaaagcaaaaaaattcgctaagagttcttgcaaatttcttttgagatgctataatatctcagtgtgcattattcacacgttttttgtgtgcgcacatgattcactaaagtgggaggagaaatatggatctccaattaaccacatcacggactcaaggaggtatgtctcgtggcaaaaaaagtagaaaaaatcgttaaattgcaaattcctgcaggtaaagcaacaccagctccgccagtaggtcctgcactaggtcaagcgggtatcaatatcatgggattcacaaaagaattcaatgcacgtacagctgatcaagcaggcttgatcattccagtagtgatctctgtatacgaagaccgttcattcacattcgttacaaaaacaccaccagcagcagtattgttgaaaaaagcagcaaacgttgaaaaaggttcaggcgaaccaaacaaaaacaaagttgcaaaagtttcacgcgatcaagtaaaagaaatcgctgaattgaaaatggaagacctaaacgcagctgacgttgaagcagctatgcgcatggttgaaggaactgcacgaagcatggggatcactgtagaataatttttacagaccctaaggaagtagcttctcagtcggctctatattgaaaaatatgggacacgtgggaggttctaccgttataaccacatcaaggaggaaacaaaatggctaaaaaaagcaaaaaaatgcaagaagcattgaaaaaagttgacgctgcaaaagcttattcagttgaagaagcagtagctttggcaaaagaaacaaatattgcaaaattcgacgcaacggttgaagttgcttacaaactaaatgtcgatcctaaaaaagcggaccaacaaatccgtggtgcggtcgtactaccaaacggtactggtaaaacacaaacagtgttagtttttgcgaaaggtgaaaaagccaaagaagcagaagcagctggtgctgatttcgttggagacgatgacatggttcaaaaaatccaaggcggatggttcgattttgatgttgttgttgcaacaccagatatgatggcaactgtcggtaaacttggtcgtgttttaggtcctaaaggtttaatgccaaaccctaaaactggtacagttacaatggacgtaacaaaagctgttaacgaagtaaaagctggtaaagtgacttaccgtgttgacaaagctggtaacgttcatgtaccaatcggtaaagtttcatttgaagatgacaaattagttgaaaacttcaaaacaatccacgaaactttagtaaaagctaaaccatctgcagcgaaaggtcaatacatgaaaaacattactgtaacgacaactttcggacctggtatccatgtagatcaagcttctttctaatttgaataaaaaacaaaacttttgttgacttgactgccttatctatggtaaggtagtcaaggttaaaagtttaactgtaccgaagacagtaggtgacgtcagtcttaatttcctaccgaggacgtttattgagaaacttcaatagtccctctatgtctacggtggcatagagtttttttgtttttatctcttgataaagacaaatgaagacagaaatgttttcttgaaactcttccatcaaaatcaggaggtgaaatttaaaatgagtgaagcagctatcgctaaaaaagccgcaattgtggatgaagtgagtgaaaaattcaaagcagccgcatctgtagtagtcgttgactaccgtggattgactgttgacgaagtaactcgtctacgtaaacaattacgcgacgcaaacgttgaaatgaaagttatcaaaaattctatcctttcacgtgctgctgaacaagctggtctagaaggtcttggtgaagtattcactggcccaactgctgtagcgttcagtaacgaagacgttgtcgcacctgcaaaaatcatgaacgattttgctaaagaggctaaagcattagaaatcaaaggcggtatcatcgaaggcaaagtttcttctttggaagaaatcacagcattggcaaaattgccaaaccgcgaaggacttctttcaatgttgctatctgtgctacaagcacctatccgcaacgtggcttacgctgtcaaagcagtggccgaaaaagaagaagatgcagcataattgccgcataatcacactataaactaaactatctaattaaatggaggaaaacaaaatggcattgaacattgaaaacattgtcgaagagctaaaaggcgcgacaatcttagaattaaacgacttaattaaagctatcgaagaagaatttggcgtatctgctgctgctcctgtagctgtagctggtggagctggcgacgctggtgctgctgaagaacaaactgaattcactgtagaattgactgcagctggcgaccaaaaagttaaagttatcaaagcagttcgtgaagcaactggtttaggcttgaaagaagctaaagctgtagttgacggagctccttcagcagttaaagaaggcatctctaaagacgaagctgaagcattgaaagctgctttagaagaagttggcgcttcagtaacagttaaataatcatttttgatttttttgagctagaattccttttaagtaagggttctagctctttttttgtttatgattctaatttcagtttgagaaaatgacgctgtcttactattagtgatccgtatttttgttgaggcgtcgaggactttttataaaaaaacaagcctaagactagcgctgagcgccgctgacttaggcttgtttattttttgcgaaattgctgaacaagaaaaatgaagataaaaaagaataatgcttcccataaagtagttgtccaactaaaggtacgactgatcccaaaaaaaagattcccaatattggatacgaccaaatagatgaccgtagcaatcaatgaaaaaattaagcgttttgccatcataattcccccttgcctttgattgtaacaattgactgacgagagagcaattattttaagaaaaggctcctgtcaaaacgaaaaaaagatgcgccattctttaattgttttgggtgctttcaggcgtgagagcaaagaggggagctctataaatttttttgattttcccaatcagttcattgattaatcaagaggaacatcaaaaatccagccagctggagccttgcgctcaccaaattggatacccgtcaattcatcgtatagcgcacgagttttaggaccgacctccgtttcactgtaaaacacatggaaagactctccattttggattccgccaataggtgaaataaccgcagcggttccacaagcgcctgcttcaacaaagcgatccagttgatccacatacacatctccttcgacaggtgttaatcctaaagcatgttctgcaagataaaggagagaatatttggtgatactaggcaaaattgatggcgattttggtgtcacgaattcattttcggccgtgatcccaaagaagttagcggaccccacttcctcaatttttgtatgtgtttcagggtctaaataaatgcaatctgaaaaattccgttcatgggcttcgtatcctggtaataagctggcagcataatttccgcctacttttgcagcgccggtaccatttggtgctgcacggtcataatctgaaacaataaagttcgttggggccagctcgcctttgaaatatgatccgaccggcatgcaaaaaataataaacaagtattctggcgcaggtgcaacgccgatattctcgcctacaccaatcaatagcggccgtaaatatagagtagccccggtaccgtaaggcggtacaaattcttggtttgctttgaccacttgattgaccgcatcgaggaacatctcttcgggaacgaacggcatacgcaagcgacgagcgcttcgattcaatcgtttactattctcatctggacgaaacaagttgatcccgccatctggtcgtcgatacgccttcaagccttcaaagcattgttgaccgtaatgcaatgctggagaaccttcatgaatatgcagaatattatcttcagtcaatgctccttgttcccaagagccatttttccattttgcgacaaagcgccaaggggttttaatatacgaaaaccctaaattttcccaatcgatttgcatagagtcacttccttttttaatttttcctagtatagcatggaacgcccatcaagtcattattttctgaaaattcatcgcaatgattttcatttctaacatcatgatgaaagcttattactagagactttatattcacagaattttttttcaagcctatctggagctctgcagttgttgataaaaagggggaaggattttggcagaacgtcgagcactttagattgtatttacggaacagatatgcttcaataagggtagaaaaaaatcgattaggaggactttcggtgatcaaagaagcggtttctgaaatccaaggtgtcctggatgcttatcagcgactggcaccaatcatgatccatacacctgccgcaccaagcaatattcttagcgcagaaaaggcaggagaaatttatctgaaactagagaatctgcagcgtacaggatcctttaaggcgcgaggggcctacaacaaattagcaacattgacagaggaagagaaaaaaagaggggtaattgcttgttcagcaggtaatcatgcgcaaggtgttgcactagcaggcgccctgctagggatacatgtacggatctttatgccgcttcaagcagcgaagacaaaaatagaagcaacgagaaattatggcgctgaagtgatcttagcaggagagacattcgacgatacaaaacaaattactttggaagcgatgtcacgtagcggtgaggtctttgtctccccctttgatgatcgagcggtaatggaagggcaaggaacgattgggttagagattttacaagatttgcctaatgtggataatgtcatcgtaccgatcggtggaggcggcttgatcgcaggcattgcgttagcaatcaaacaattacgctcggaaactaatattattggtgttcaatcttatcaagtacatgggatgatttcctctatatggcgacaagaactgatagccaatcgcagcagtaagacattggcagatgggtgcgatgtggctttggctggagaattgacttatgaaacgttgcgctcgcgcatagatgaaaccgttttagttgaagagaaagatatcgaaactgccatccattatttggctttaaaagaaaaagtgattgctgaaggggcaggtgctctgagtacggctgctatcctaagcggacaaatcgatcatttgctgaaaggcaaacgaacagtcgcaatcgtttcaggcgggaatatcgatttctctgtttttaaagaaatcatttaaaaaaagatgatctcagaccaactagtcgtctgaagatcatcttttttagtccgttttcgatccagttttcagaggagaagaaacgtttactaaaaactgcgaccgccgccgccaaatgttccgccgccggaagaatgagtagtggtgccaccgccaaaaccgccgccgccattatttttaggtggacgtgggattcggcgagtcgttacgaaggagttgaccagacgatcttctttttgagtcaatttgatgctggatttttcttggtaagggtatttgtatccacccatttttaattggtatcttgatttgacaatgatgaaaaaagcaatactgatcactgcagctaccaataagctaatgccgatttctaaaggggtcagcactttataataagtgatcttgcctgtctcacgatccacatgatagtgaccgccgggaacccccgcttctacatagctggctgcattctccaagtagacccgggcggcttgatagtaattacccgccgtcatctgatcataaatattatccaacatatcatcaagacgagcgtcgttgatataatcgagcatatttcctgaggtggacacatgaagattacggttgcccatatcgatcatcaatgccgagccattctgatcatttccgatgcgatcggcgagaaaacggtcggtggtatattcaatatcgtcaattttgttatttgtcgttgcgataaaaacttcacctttgattttctcattcaactgatcggcttgttcgctcaaactctggatttcggagggagtaaaaagaccagcgttatcagtaacggtattttctgctgccacgccagtgaccgtcgtcagtagaaatccggcaaccattaggaaaaaacaggaaaattttctcataggaaatatcctccaatcatccctagaatcgcaatcacagcaaaaatcgctgcactcgtaaatcctaagcgtttgtaactgatgggcaagacaccgctgactttaccggtttggccattcatcgcataataaaaagcattcttattcggatcatctgcccgataagtgaccagccagactggtagtaggacgtaatgattggtttctttcgtgatctcaatgtcccgctgggtccgattgaagcttgtataaccattaacggtactgcttaggagattttcagcataaccggaaagttcctgttgtacttcattcttaagtgcttgatactcaatgtcgcgtttttctgcttgaaatcctgccagatactggctgcgaaagtcaacggccttatccaatgggaaaggctggaccccggtaaccattttttgttggacattcttggataaagcgtttttgatcagttcattgatacgcatttttccgcgtctggaaacagcaaattgtttgtgttctgtatattcgatctcgccgacacgccaaattcttaaagaagttccagttccagatagttggccatctagttcggcatcgatcctccagtaggggaaataaacaccggtcaatttttcaacttgcgcttgatcgaagaagtctcttggtacgaaccattttttttgtgcccattccagaaatttagcggttgcttcttctttttcgattgcaaaaggtaaaactttgttaggtaagaattctccagaaagacggccggaaaggacgactggattgtggcagaaataacagtaagtagctgctgtcgtagcatcagtgacgatctctgcgccgcagttaggacaaaggaacaagtccatttgggccgccttttcttcggttttttctgtgatagcttcttttagcgccggttccgtatcatcagtgatcggctgattttccggcgcagtcccatctgcaagttgggcttctttttgtttttgttcaaaggctgttacttctgcttctgtaaaaatactcaaacagaaggggcagtggaatttttgatcaccaggatcaaaggttagcgcaccgccgcagttggggcatttatgcgtaatgacatccatttaagttcctccttcatttagtctaaaggaactcccttaaatggcttgccgcagttgggacagaatttcgggattccatttgctaaatcaattatttcactacattctgaacatttcatttgtaaacttggggttcctgtaggttttgctgtaccgcaattgctgcagaacttacccgtattgcttgttccacactgagggcagtcccaactatcgccattgttttgtttctgctgattttcttggttttgctggatttgttgctgattgttttgagctgcttgattcaagtaaccgccagttgtgttcatccccatgcccataccaacaaatccggttgttgcaccggcagcattactacctgcggattccatcccacgtgcgatcgaaccttgaacatacccttcacgaacatttgggtcacccaacatggcaccttgattacgcatgttgatcagtttcactgaatcatccgtataagagatgcttgcaacagcgactgaaacgatttccattcctcgcagttcgcgccaactgtcgtctaaaacctcacccatgtatttgcttaattccatactttttgatggaacataggagatgcgctcgccatccgctgacattttgttgatggctgtctgtaaagcagtcagaaactctgctaaatattgttcgttaatgtcattgatgtcaacttgtgttttattttttggaatcgcgttggtgtagaataagatcggatcagtaattcgcaatgagtaatttccatgggctcttaggaataattctgcattataaaagttgtcaaaataatttaatggagaagaagtcccgaagcggattcctttgatttcttgcaaattgatatagaaaacttgttgtttttgaggtgttacgccaccaaatttgaagcgattaaacgtttcagagatggcatcctttaaggaaccgttgaacatggaaggagccaagtcatttttgacagtatagtagccttcctctgctgtataatcaatgatttttccaccatcgaccagcagcatcatcatattagggtagacgtggattacagatccatctgttatgacatcctccgttccttttcggttcgaaccgcgtttgtcattgcgccgtaccttcacacctttagtcatcactgtcgtgtcgcccatattgtcaggttcgaagacctctagccattggtcggcaagacctccgccaatcgtgcttgttgcagctttgataatacccattttcagtcctccttacaaattttcatcatccaatggatgaatgtacattcattataccatagctccgtattttctatgtattagaccaaagttgtagaagtgtaggcaaaagttgaataaaaaatcgtctataaaacaatacttttttcaaagtatcgttctctaggatgtgcggatttttattaaaagattgctcccttaaaaaatcatttctttttcagcagataggcaactcaaggtagttttttttgtaaatattacgtataatagataatagcgaattttgaaaagagtgaggaaaaatatggcctatcaagcattgtaccgtgtatggcgatcccaacggttcgaggatgtcgttggacaaaaagcaattacgcaaaccttgaaaaatgcgatcgagcaaaatcaaatttcgcatgcttatttatttaccggtcctcggggaacaggaaaaacgagtgctgccaaaatctttgcaaaagcaatcaattgtccaaaccaagtcaatggagagccctgcaatgaatgcgagatgtgccgttcgatcacagctggtacgcaagaagacgttatcgaaatcgacgcagccagcaacaatggggtcgaagagatccgctttatccgagaccgtgcaaattatgcaccaacacaagctgaatataaagtatatatcgtggatgaagttcatatgttgtcgaccggcgccttcaacgcgttactgaagacgttagaagaaccacgaaaaaatgtagtgtttattttggcgacgacagagccgcacaagattcctgcaacgatcatttctcgaacgcaacgatttgattttaagcgaatcaatacgcaagatatcgttgatcatctaaagacagttttagacggcagtcaaattgcctatgaagaagaagccttgcaagtgatcgcacgagccgcagaaggtgggatgcgggatgcgttaagtatcgctgaccaagctattgcctttagtgatggcaaagtcacgactcaagacgcattagaagtaaccggcagtttgtcttatgagatgatggaccgtttgatgcaattttgcgaagaccaagcagtaccagatgcattagagacattgcgccagctgctgtcttcgggcaaagaagcacggcggttgttggagaacttgctggtctattgtcgtgacttgctcttatatcagcaggcaccacaattattagaagaaaaatcactgcagatcacaccaggcttcaaaac

SEQ ID NO: 4 - DNA, 42883 bp, Enterococcus gallinarum strain MRX518
taagcaccatcatctataatttcgttgaactcttcatcataatacttaaaatctttgtttgtaagttcaaaagaaacagtcacactatcccctgacttaacaaaaaccttcttgtaggctaccaagtcttttgttggtcttatataacgaccatattgagctccaatatatagttgaacaacctcataaccatctctacttcctttatttgaaacggtagtagtcaccttccaacagttcttacccttctctttaatgctaattggtgacatagaaaaagtggtataactcaacccatacccaaagggaaattgtggttcattggatacatctaagtatttggtcgtattaaacttttcacttgaatacggtctaccagtattgaaataattataataaatagggatttgtcctaaatgtctcggaattgttattgtaagctttccggctgggtttattttgccacaaaggacgtccaaaatagcattgccagcctctgctcctagatgccaagcctcaactaatcccttacagtacggtagaattttaccaactaccataggtctcccattcatcaacacaacaaccattcgtctattatactgatatactgcttttaaaaagttatcttgaatggcatctaattctatacttgctttagattttgcttcgccagattcaatagctttttcccctaagacaagtacgaccttttcgttttctgaaatagcttttatcgtatcttctgacaatattccatctcgtcggaacgcattgaaggcctcagacatcgcaacataattctcttgctcatttaatgcctcagccacacttacgatatcttcagctttaccattacaagcccatgtatccaacatagcttcctgatcagtgacgagtggacccataaaaagtactttttctgttttttttagtgggagaatatcagcgtcattttttaatagaacgatagattcttgagcgatctttcttgctagtttgcgatgctcattctttcttttttgaacttccttccaccgatcaacactagatctaaagggattatcgaacagtcctagccggtattttaactccaatactcttaagactgcttgatccaaggaatccgccgaaacagtctcagataaaatgagttcctttagataatcatgatacaaccgagaagacatatcgacatcgagctctgacgccatagctaatgtgactgcttgctgttcatctctacaatagccatgtataatagtttcttttaaagcattccaatctgagatcagtaaaccattaaaacccatcttatttctaagaatatcaatcaatagtcgtttgttcaccgttgagggaataccatttaaggcattaaaggcactcatcacactcaataccccttcatctatcaattttttaaaaggtggtaagtatacatttgagagtttatagtctgacatatcgaccgtattgtagtccctaccagcttctgattcagaataaccggcaaaatgctttccacaagcaatcaatctatctttgtcaagcaacccatttgtcatctctccttgaaaacctcttatttttgccgccccaaattctgcggtaagaaatgtatcctccccaaaagattcagctaccctgccccacctcggatctcgactcacatcaatcataggagcaaatgtccagtggatgccagcagccgatgcttctcgagcagcaacttcagcagttcgcgtcatcaagtccttattgaacgaacacgactcagctaagggaatagggaaaatagttgaaaaaccgtgcacaacgtcttcagcaaaaagtaaggggatttttagccgagtttcggtaatggctatcttttgtaaccgattagactgctggatatctttgattgataagaaagacccaacttctccattcattacgagttgctcatagtgttcctctttccctccataaattgacgtcccaacttggttaatctgtccaattttctcttccaaagtcatctttgccagcaaatcatttagtattttatttttattatccttcattgcacatactcctgtttttttgtaatatattactatccgattgattgaatcgctttttacgtccttatagtaacaacttttgttaacgtttactttactgatactaatattaaattgcaaaatagcatacttaccaatctgctagcaacttaggagttgaatcaatgaccttgtccttatcattaaaagatgcctacttttttagtcgtccggtccacaagtatgcgaaacaattgattgaaaaacgatttgtggattgtttcgagattgacatcattactgaaagtaacggggggatgtatattaatgaccactactaccccgttaaaaaaggggatacagtttttcgttatcccggtcaaacgactcaaggagttataccctactcctgttatgccattcgttttcaaactgatgactctctctttatcaaaacagccgaaaaggctgtccccggcgtatcgtcaggagaatctacccgacagatactaccaattattgaatctgtccttaatgaacgaatcgatcataatatgttgtcaaattatttctacgactatcagctgtctaaacttgtttacagtttactaatgctttttcatccaaattctaataaatatgaagacgaccaatcgaactacaacccttatgtgtcagagtgcatttcttttattcaactccattggaaaaatgtgacgatcaatgacctcgtcaatcgcactggcgtgagcaaaccatatttgatgaaactctttaaacaaacgactggaaaaacaattttaaattatattaatgatttgaaactagaacatatcaaaaagatgttgatattcactggtgataatctcaccgaaatcgcattaaactgtggtttcaatagttcaagctattttacaaactacttttcaaaacacaccggattatctccaaaagaatttcgtaatatctatcgaatctagtcgtgatttgactttaaaactctctttaaaataaactcggataacaaagaaccacacttcattttccagaagtgtggtttttgatatacaactattcaattaaaagactattcgactaagcagatattcagatctaatataactactcactcttctcctctgattctttttcttgcatcagctcgaagttcgtaaccttcatgatctttaagtcgtagtaattagaacgcttcccgaattcttcattcaatgtatcatagccaatttcttcggacagggtcggtttgtcagaaaagagattcgttcctaatcccattctttctccttctatgtcgatccccattgcagccaacgtcgttggataaagatccatagtcgtgtaagtcctattagccgttgcaacaggttctgtgtcggagtttaagatgacatctataatagaacgtttgtaatccggagccacgctattgaaataatcacgatccatactcaagtgatccctgacacgacaacaacagtatcttcataaaaaggttgttctttcatccatcttaaaaaatcgcctaactgttgatcggaaaatgatggataggctacaattaactagacagaaaaattaaggtgtgtagactagaagaaaacataccaggaggaatttttatgtctaagagaacacgaagaactttttcacaagaattcaagcaacaaatcgtcaatctttacttagctggaaagccacgtgtagaaatcattcgagaatatgaactaacggcttcagcatttgacaaatgggtaaagcaatctaaaacgagtagttcattcaaggaaaaagataatcttacgcctgaacaaaaagaattgttagaactacgtaaaagaaaccagcaattagaaatggaaaatgatattttaaagcaagcagcgctgatattcggacgaagagacaagtaatcgatgcgaataagcatctttaccctatatcagcgatgtgcagaataataggtctatcacgtcagtcctattattatcaatcaaaaccaaagaaagacgaatcagaacttgaagaagtagtcgctgaagaatttatccgcagccgaaaggcctacggctcaagaaaaataaaaaaagccttatcaaaacgaggcattcagatcagccgacgaaaaattagtacaatcatgaaaaatagaggattaaaatcgagctatactgttgcttattttaaagtacatcattctacttgcaatgaagccaaaacgacaaacgtattgaatcgtaaattcttaagagacaacccattagaagcgatcgtaacagacttgacttatgtacgagtcgggaaaaaatggaattatgtctgtttcattttggatctgttcaatcgagaaattctcggctattcttgtggagaacataaagatgccgttctagtaaaaaaagcatttagccgtatcaaacaacctctgacagaggttgagatttttcatactgatcgtggaaaagagtttgataaccaagctattaatgaattattaacaacttttgacatcaatcgatcattgagtcataaaggctgtccttttgataatgccgcagctgaatcaacttataagtcgttgaaagtagaatttgtctatcaatacacatttgaaaccttacaacaattggatttggagttatttgactatgtcaattggtggaaccaccttcggttgcacggtacacttggctacgagacaccggttggttaccgtaaccagagattggcgcagcgaatccttgataatgagctcggatgtgctaacgctagcgaggcagtctaactttaactgttagctcctgccgaagatcgtcacatccgaggaggctcattgtcaaggacaatcggaatagcatacggaaagaagttctgcaccttataaaatttgtcaaaaaaactgttgccattccatcaatttttaaaaccaaatatatatcctgatttcaatcactgacaacacatagattcttcttctctaacgaatctattataaattgagatagttcataatcgctagatattaatttatccactgtcaaatttgctggattagatactagtattataaatgtattttaaagaaaacaagtgtcttcttcacaactattacatctcctccatcctcaaaaatttataccaaaaaataagaaaacaaatgcaatataaaggaggattccccctcccaaaacaataaaaaagtagaaaacgtatttagtcgttttgctaatatcattcgcatttcttatcttaatactaataaaaatataaaaccctatgagtattaaaagtggtagcattttgatcaacaatttttatccttcctttgagaaaatcattttggaacttttttttttatgttaaccgatattataatttaaattttaatgattattcatacacattatatgcgtcaagtaaatcgctataattaaaaactaagagatatactgtaacaactatacgtaaaatagcaatacattttgaaaatggatcaacttcaacgttaaagacacttttaattatgttagataaattaatcgccacagtaactcacatggtttcttgaaaactaaaaatgcggccgcaatcctttagaaatttactatagatctactctgaaaaataaaataaattcactaaattgaattaaaacgtttctaaataacacaatttattacacttaaatctttttataaaggcctacataaagatttacaccatttttctgaaaaaaatactacctgtccaaataatactcatattccacctgtaaacattttaaaaacataagagaaagcctagtattctttactcagcttttatagatacatatatctataccttcaattccttcttccaacattcataagactcaacagttgcactttttttcattctcctacaaattccactaaacaatgcccacttataatcatcaagaatggcagtacctactccccctaatcctaagaaaaacagtaaaagtaaatataaaaataacatcatattcgtccataacgataaaagagtcaacaaaagagaaactaagcctactgtaacaaatgaaaagaacagaataccataataaatcttcaaaagaacagcccattctttgatcctattaagaacagataactcatcctccgtcatcaatcaatccacctgttctttcttctttttagggtcaatactctttaagaacttctcctccaacaccaataaatgacgatatacatcatccattgaccagcctgaagaaaggctaagacaatacaaaaaatcacaaggcaacgtctttactgtgcggtttcttgttacccagcttgctactgtactctgcttatatccatgcaactcacaaaattgctctactgtcatacctaaccgcgaaataataaatacattgatcgggtagggatatacaaaggtattgatactcatagtcagaaagacctcccacggtattattacgtttgcgataataatactactctttcttaagaccagcaagcaaggcggagaaaaaagaagtaacgtatcatagatataatgtaataggcaatttgcacctttttatttcaacctgtatcaatcatgaacagatctgtttgcacgccgatcttattgggttctatcaagcgtttcaatgctgtctggataaacgtgtattctcttccaaaagcttctgagatcgcagcgaaataagctccctggctttctttttttagccggataacagagcgcatcaatccatgtatcgaagctagcataatacctcctttacgaccagcacgaacacgaaaatgaattttgttctcttctctcaactgcttcagcactttgtccagggaacgttttgggatctttaaacgttcagttaactctttttttgtagaaataatgtatggttgttcttcataggattgctcattcaaataggacagtagatcttctgcccattcatgactatgtgaatacttgcgaacagctctttctttcttgaatttccaccaaccccgttttttgttgaatagctgctcttcagaaagattggcatcgacccactcttggcataataggacaattttttctctgtgcgctgcttgatattttccggagtaagcggaacgaatgattctggttaattctcgatcagataaagggttagccaagcggtcattgaattctaacatcgtcaattcacatgcttctacttcgtatcctgacgaaaagtatgccaaagacaaggtgaatatgacattatttcgaccatatacgcccttttcaccttgtattttttgactttttagcaacagctggaaccagggttcatctacttgacgaaattcttgagtagatggtaatacaaaaacgttcttgatctccgcttttttgtccgcatcttctctcattgaccagtcgatccattcttcgaaactataacgatactgtggttcaaagaataaaacattctcttcagaaggcattcttgtgatcccaaaatgattggcatttacatcgacaggaaaccgataatcatttgaaaatttgtttcttagattttttgagatccttttggccacattgatcactttaaaatttgatttcttcgtcacgtatgcaggcttgtctagtacatagaaagcttgaaatccatgcggtgtacgtagaatcattgtcggcataaagccgatctcgtgactggccaagataatttctccatagtcaaagtttggatccaatttgtcaaaatcaacaaagaatgtattgatttgacgcaaattgtcctcagaatgacctttcgtaaacattctggcttcatcagcatacgttccatagcgaaatacatttggtgtccaatgagtgaatcgattattgttttcgatcaccccttcttctgaagtgatcactagtccaatcccctcgatcatgtgttcctttgaacggtacgcaaaaatagccccctttcccgactgatcactaaaagagaccggttttaagtggctgtttttatatttaaatttacgaataccattttgtaataccgtcgaatatacgacatccaaagaagctgccatgactgttattccttcctaaacaaaaagagaacacaaataatctttcgatttgtgttccctcaatggcttagaacgtcagcatctcgttaaatcgcatgacaaaataagcatatatatattgagttgcccgtcaaaaaatggtaaaataaacctataagttcggattaccagtccgaatagatttaattaaatcacataagtggtaaccagccacttacataattctgagacgagcgagaacacatagttgtgtatgtgattcagatgaaagagtgaggccaaattcacttttttatccgtctctttttttttgatttattttcatattaagaatatatgaaaacgccatttaattcaagcgctattttctcaaaaatccattacatactaccttaaatatagttttcctattattatttactactctaattaaagattaacaactacatttgtagagataattattataatatgtactacttaaatcattaattatctactacgattttgtctcatattttatattatatactaccttaaaaattaattatctactaccttataacaataccattgataggtagtaattaatatattgttctttaggtagtaggtaataaaattaaaatacccttatctaacttatattatcctgaaatcatgactacatactaccttaatagaattggttactaccttttttaaaaaatttctaaaattacttactacctttaatgagagtattgtttactaccttattcctttgttatatactacttttattttaaatagatactacctaaaaagtatattatatactaccttattccattttaaaaattattacttactaccatatttagaagttatctactaccgttttatgcttttaattactacctaactaattgaatttcaattgcaacaattcgcttttatttaagtactaccttaatgaactaattttactcgatcataagctttataaactaaccaagtaaaactgacatcccttccaaattaagttttccctcttaagatatatttaatacaactagcgtcttaataacgtgtagtgactaatagagtagtcttgttttattatttattacagtagtatatagatattgtttttaaagtagtaactattttataatatcaaaaacatttatacatagaatttattttgggtagtatgtaatttaatttacatagcattatttatagtagtatgttactattattataaaggtagtagataataaaaggagtgagttagcttgtcaaagaaatttgtgataggaaatttcaaaggtggagtagggaagagtacgtgtgcacagatgttaggtttcgaagcagctgttgcaaaaaatcaaaaaactctgatcgtcgatctggatatgcaagggaatacctctgacgtaatgagcttaacccatatgaacttttctttagaagagggtggtggaggcggtaagcctcttgattatgaaaatacaataaccgatgtattgattggaaaagaacctattgatttaaatcttgaaacctatggggaagttgactggaataaggtagtagataaagatactcgtgtagatccaaaagatgctatatataaggtagtagataatttatatatattacccgcagatatgagctttgaactttatgatgattggatcaaagaccaattctcggattctgccgataaacttatctatatgcagaaacgtttaggaccgctgcttgaagaatttgacattgtatatctagacgttccaccttccatttcaatttatagcaaatctgcaatgtatctagcagattatgcgatcgttgttcttcaaacacaggttaagtccatgcgaaatgccatgcaatacttagaatatatggatttctttgttgaaggatttgatacttcattgaaggttgctggtgtgattccatttatgttagagagtggggacgcagtcgatcaggaaatgtatgcccaagcacaacaaatttatggtgatcatttgctcaaaaatgttgtactaaaaaatgcacgtttaaagcgatatgatggatctggaataacaatggagttaactaaggctgggaaattaaagcaatgggataggcgttgccaccatctatttattaatatctacgaagagctgcttgaacatgaggcttggtatgagtaggaggttctttaaatggctgatataaaagatttaggtatttttagaagcaacaaaggattagataaaattagggcagggaactcagctagaaaaagtagcaagaaacctcaaaccacgtctccatctaatgatataggtaccacaaagtcacaggaagatacaattaataataaagaagtgatccacgaatctccgactccttcttctgaagatactggacaaacggtcattcaaactaagaaaaaaaacagtctatctaagaaagtaaaaggggtaggggctcctataaggaaatttgatcgatctttctctgctcaaatgcctttgaaactttcgcctattttaaacgctacttcaagagtgatggttgaaaaatatgaaacaaatcttactagagacgagatactacgaaaagcactcgatgaatacatcaaacagcacttgacacaagaagacaaacaagacctttttaataatgttatgagggaagtagaaatgtttagggagaagaaacccactatcccagaaacagatgtagatggaaatataattcgtacagtcagtgaaatagaagaagaaactcaaatgattttacgaactaattggggaatgaattataaacattaaaaatctactaccataattagccattatggtagtagatttttagtttattatagataccataaaagtagtacgtaataaaatttcatataaaagtattcattctgataaattttcaggaatcatgggaaagatgacgaagaaattaaggtagtatataacctttatctactaccttaatcattgaactttcttcactatttgttaccattcacattcaccttctctttattatgtaatcatagttacaatctaatttatccaagtctaactaaaagatatatcaaacagtaaaatgattaatattactgtgcagggcaaaaaattaatagttattgagcgatatctattttttgtcaactcatataaaatcgcttcagatttactataaatttaaataatctttcctaatttacaattcagaaataagaaactaatatgatcatctggataggtgattatattagctttttaaaagaatagataaacatctggtgaggaagaggactacttatcagtatgatgaaaagctattagttaacataaatattttaaatacgttatatagcttgataattatctgttaaacgcctttaactttgtataatatatcttatgtaaactaaaataattatgtattcttaaaaataatgaacataattaagattgacctattgtgacacttgcgtgggatcacttactagtaatcaatctagtgcacgaacttttaatatgttaaaattagtagtcgcctatccgacagtcttgcgactggagggaggtgttttcatgattcaattcttcatttgcccccttcttgtcggcttactagtagccctcttcgagtattggctgaataatcgagacaagaagtaaagcaacgaaggcgacatcagcccacaaaatgaaaccccagagaatccgacctctctggggtttcgtggtgttttcatgtccaataattcatttgcatgtatattttaacatgtaatttcaaggaaatcaatgaagacaggtattggaaagagcgctgcctgaaacttcaataacgggcagcgcaactctaaatatacaaatttaagtatatcataataaaaaaatatgaaaaaatttgaaggtagtgaagattctaccgtcgtttgctttacttttattcttaataagttttgtaataattactcgacacggtagttcgttagctacgcagccactgatcgttgcatagtttctgacgttgttcttatgattcagtaactcttattccgtttgcctcctaatagttcatgggcgaagcgcgtccgtctaaaatagttgcttctatcgtttgaacctcattgacaatttttggagaatcttaccatcccttttcagcagttaaatgtaaaattctttaatagctacgcttatttttcatccagaatgataacctcccaaatttttccttctatctatatagcatcattttgtgtttcacgtaattgagctagttgagcaaaatcaattaaagattcaatcgacaatccagcatttcgcaagttttttgctagataaatccaatttaaatcattggtagtataatctcggtagccgctctcgtggcggtgaacgggtggtatcacgccaacacgctcataatagcttagtgtatccacacttaaatcaaacatttcagctgcttttttatattcatcgaatctcctcctcattcttcttatttataataaaccatggagttaactctagagaaaccagaagcctcttgtctctatgataatactacactaaatacctcctcacattccgtagactattaaaatattaagcaatagataaaatcagttaaatgcaacttctcatattctaatgtttattaagtaagaataatgttaaaataaaaaaacgaagagtattcggcgcagtccagaaaaacttccccaagttttctgtgccggtactcttcttagattaatgcatgttgcttaatcagcctacgctatatatttcttttttgcaagtaattacgatgtagaagcaatgcttaggaatcctttacgttttttctatttttacttttgacttcttttaagtgctatactggataagtaccatgaaagtaggtgttcaaatatgaatactaatttttatccagtggaagtttttagttcggactaccgtttatattcatcaaaagcaaaaacaagtttgtatgattttcaatcgagaccacctttgatcacgtcatttgctgtgctaaatttgaaagagttgcgcaatattcaactcaaattatttatttacgatattgatatcgaaaaattttctactttagaggaagctaaatctagatgtaactctcttatgtataaataatttaactagctgatcatagctagtttttttgtatatctgtatctaatgaactaaatgttcatccttaatctgcttaataaaaagaaatatttatcgctaaacttatggtggcggatttagaagtttatagattagcgaatgacacagaaatatctgccatctgctatgggtgaatcagataaaatatatttctggatggttcctttgaagagtttttctccttcacagcaactttttaaagaagtatacattttttcagaaccatccagataataaacattgattccctgaatctgattataattaatcggagaacgtcgtgtacaagaaagttgatctcctagatatttcacttgattaacaatcattgggtcattaagccaatttttgttaagtgtcaattttacgattaactgatgaatagcttctttttgcattttattcctccactcaaaccaatcgtctatccagttttacatatacatagtacgtgatcaaaaaactcaatctattcttcattgatctcagttactcattaaatttttataatttataactgttctttccgtagtattcgtcacttctgaatttgaaagggttacaactgccgaattgctgagtagctttataattgttccagctgtttgtttttttctatatctaaatatgacctgttgatctatatgaaaagattggccttctattgaaagttgttgtggtttccattgtgaaaaactcattcttacccctcctttgaagtatgaaaaaaccgcctcacacatgttgagacgggttaaaaggaacttttatgctttatagatattagcagcttgcaaaccgcgttgaccttcttcagtatcaaaagtaactgcttgaccttcatctaaagatttaaatccatccgcttgaatcgctgaaaaatgagcaaagacatcttgaccatcttctcctgtaatgaacccaaaacctttatctgaattaaaccattttactgtacctttattcatactgtttcctccttgtgcatctcttcgtatgcgttttgttgcaataaatgtttgattggcaaaaggagagtataaatttaagcatagcactcttaatacgtttcaaaatatatcactacaagtagtataccacataattatataggaatgtagttttttggaaataaggtatttttttaaaataaaacttaatgatacgaattttatgcctcaatcgcctagtaatattcatatatttcagctgcttgatataatatgtcattattttccattgttttttccttacaaaaaaagagatttctttacgaaatctctaaaagttaaattatgagtgttttaattgctggtttgaggtgtacacacacaaccctattaaagctcaaaccaccagtacattccaacgcaccgaagactatcacagctatagtagatacttaagttacctacactattgtattctcatatttgtactattttgtcaaacatttctcgtgaatctacactaattattagctttaaaaaggaatagctatttcactcagacgaatcatcggtcgaccagttccttgaaggctgaatcatgttcagttagagcttgattagcgaacatctcaatttcataaactaaattactatcctcttttatatcgactttgagtttttttccttcacgataatatgcttttgcgaattccatatctttttctttatttcactcaagtctttaatcagcacaagtggcccatcatctatacgttcttttgtgttttccatgataaattaaaggattcctcaattaatttacttgatactttatatatcttattattccgcctaaaaatcattcattgactgttttactttttctagagttattattgcccgctacttttcaaattctttgctaataattaataccaaagatacagtattcatacataaacgataacatctccaattcatcaataacttgactactattatagtacctggataaaagcttattaaacttttcgaaaacagattcaggtatcgacagtaatccaataccgtttctaaacatgatcttattagcagttaacagtgcagttctcttattaccgtccccaaataattgatttttcgaaatgaatagaaacagtcgcaatgctttttctgtctctgacatatcttgattcattatctcgtcatattggttctttacctcgtcttcagttaactttggtggaacgtatcttccttgaatagtcgatccttctcccccaccggttcgtatttcaccgggaaaaagcgcatcctcagctgcaacgatccgattaatccgcttacttgtctctagcaagggctcctgtacgtcgtttaaaagcatttcaaagcctctttttaaggtaacgacgctcaggacatcatctacagccacattattggcccgattatacttaataatctcttctgtttgtaatagtgttgtattcaatcctgcaaattttcccgcattatacaccagttccacaatgtttttcttcaataaatacacagactctttgcgagataagtggtatttatcaggaaatttcggacgcttttcttcgttcattttctcacctattgagtttttccttctattatatagggcattattctgtcatagatccaagctctttactgcggtatccttatcttcctgggtgatcccaatatagcgtaaggtctcccgttgcgaagaatggttgagcagcgactgaatgatctctgttttggtcccttgtttgtacaaaaaatagccgaaggtcttgcgcatcgaatggggaccaatttctttcaaaccaaccgccgttcctgcttcatgaatgatccgccaaaggctttgtcgagtcaaaggcgtatctgctccttttcgacttggaaacaaatacttgctgaagtcttgtgctcgcagctgctcaggaaattctgactgaacataatcgagaatcacttttcgtaatttattcgaaatgaagactgaattgtgtttggccgttttttgttccttcatggccagacgttctttgacgatcacacgtccacgggaaatttctaacacatcacttaattttaactgtcttaaatcggagattcgatacgctgtattgattccgatcgaaaaaagcaccaaattccgttgcccatatttgccggaagccaaaatggccttcatggcatcgatcttttttttgtcacgaatcggttccacgctcttcatttttagacccctctcaaatgttacttaatatgattataacagataataagtcacatttaaacaagctatagaaaaaagacgctaaaagaaaagtgattttctcttagagcctctaaggatggagcgattttaacgaatgtgacacaatacgattgtgtcacattggtcttttgagattttcggtaagatttgattatctcagaacattaatattgcccctttaaaaaattttgtcagtacttttaagttattctattctgaaaattcaaaattttcagtctatataattaacttatattcagttttaccaaatgataagctttaaaaagtattcagaatttagtcatgttataaatccaataaagtagatatggaatatttattttctcttgtctaatttataagaactaaatgatttcatcattgttttgacacttttagttgggagcgtcaataattttgtgtaaatggttcttccctactgtagattgtttctaattctccatcggttgactcagcatttgttcgagctcgccttcggcctgttggaaacctttatgactgcgacctaggaatttttggttgtgagtatcaaaagacgagactaagaaacgttccatcgactcttcattttggaactgttccttgcggtggctgtatttcttgatttgcttattaaagaattcaatcaagttcgtagagtaaatagtcttgcgtatggctaatgagaaaccatagaaagtgagcaggtaatcgttcgaaaggatcgattccactatttttggatagctggttttccatttttccgcaaaagcaccacgttcttccaatgccgcctttttagatgaggcttgatacaccattttaaaatcatcacagacttccttacgatcatcgacacgcactttgtgactgatattacgggaaacgtgcacacagcaatgttgaaaacgggctttggggtagaaccgctgcacggcccctgccatcccctttaagccatccgtgatgaaaaggaggacgtttttcacgccacgttcctggaggtctattaaaatctcttcccaaatcgtgatagattcagttggtgcaatcgcatagctcaacacttcctttgaaccgtccgggcgaatgccaactgcgatacgaatggcttccttggcgacggttttccgctttaaagggatataggttgcgtccatataaatagcggcataacggtcatgaagctcacgttccttaaatgaagtgacttcttccgtaaatgatttagtcatattggacatggtttggggcgtgtagtgatgcccatacattttctcaatcaagtctgcgatttccgacatggtaataccttttcggaagaggtgaatgacggtctcctctaaggtatcattcgtccgtctataagcaggaacagtctgttgcttgaactcgccgttgcggtcgcgcggaatctgaagatgaagttccccgtactcggtcttgactgtacggtcataggagccgttacgagaattacccgtgttaaaaccaatgcgatggtacttttcgtaatcgaggaaagccgttaactccgttttgagaagcgtattgacagctttttccaaatggacacggaataattcattcaaatcgcctttgttcgctagagtctttagaatttctgtagtaaaatcgttcatatggaagtcctcttttctgtgaatgtgttgtggtaactctattctacagaagggacttccttttttctatttacacaaaatattttacactctcgaaaatttctctcccattttaatataaacaagcatctttaatatattttaattacttattgttatagtattatacattttgtaaattttattttaaagctttaatgttatgatagaaaaggatagcttcaatctccactagatacttcagcgcattcactatttttgctacattctattctttgatagcttgtcttattatcctcaatttatacaaataatctctcgcaatgagtactgtattcctattaaaatatcataatttaaatctagtttttcaatgaacagcattctgtttctaatttaattacatcatgcatttgaataaattggtgatttcttgtgtataacttttgtttctcatttacgcctattaatcatgtagtagattttcattaagtagatggtattgtctcaaaaaaagataaattgaggtaaataagaacattaagccagaacatattatcaatacagcaattactttcccctgatatgttactatatagtccccatttgcactaattaatgttctaagaggtaatgatgtaaacgttacagttaaaggaatcaagattaataaactgcaaaataatctaaaaaataaagatacttttgatttcgtcaatcccattgttcccccaacaaagggtactattagtataaatatgggaattccaaaggtaaaaatacttagagtaattattgttccccattcccataggaataatcctgctatcatgaataaataactgaataacatgattaaatgagtaccttttctaaattgatttaatatatgtattctcttcctttcaccttaaagtgttaatgagtgacttacctaaattttttcttaggctgcctagaattggctaggctagacagaaaaattaaggtattaaaaataataaaaaaatactcgagtattttttagtgaaaagacctcaccgaagaacctatgtaaaataattcaaacaataagtaatcaatctctcccttacaggtaaatcacataccgaaatcattcaatattacgagcttcatagcttctgattctgatagaagagataggtctcctaaggacgcttacataaaacatgggaggaattaatgaaagaaattggatttgcaaattttataatcaagttagccacctagaaaataaaaaaacatcatagtgaaaaatcgtgtattattgaggttcctacaccgatcaataaggagattttcactatgactaacacttattctacaacagaacgtgccaaaggaaaacatctaactgctattgaacgcagaaaaatcgctggttaggctgctgaaaagctgtcgaatcgagaaattgctcgaagaatcggtgttcatcatacaaccattgccaatgaacttgctcgtggtaaagtcgaacagacacgaaaaatcaatggtaccaaacatagctatttcaagtatgatccagagtatgctcaaatctgctatgaacaaaagcgaaaaaagtgtcactgcccctctaaatttcattaagtaaagtcttttctagcttactttgtccaacagtttcaaacagctaactattcacccgatgtagcagtcggtgtcgcaatctttcagccatcggagatggtgtgtacaacgactctctacaaatacatcgacgaacagcgattagaaatcagaaatattgatcttttgtataaactaagtcggaaaacacataagaaatgccctcgtacaaacaaaaaagttttaggtccaagcattgagcaacggcctgagcacattgattctcgtgaagaatttggacactttgaaatcgacacggttgttggtaaacgttccggttcagaaacggccttgcttacccttacagaacgtcaaactcatttttagattattcgtatgattgatgggaaagattctgattcggttgcctatgcgatggaacaattaatccaacaatttggggcagagagttttaaaaaggtatttaaatccatcacttcagacaatggatcagaattttctactctgaaagatacactgggaggctatactgaagttttctttactcacccctatacatcatgtgaaagaggaacgaatgagaatcataaacgcatgattcgccgtgagatacctaaaggtgaaagcttagaaatatatgggcgcaaagatattcagaaaatcgaagatggcatgaatgaactatcaagaagaattcttggttaccagtccccaaggcagtgatttgaacaagaataccagatagcgttgagttgatttgacagtgagcctcctgtcgtatggcttcacgtctgggaagtctggcatatgctagctcactatcaaatcaacaacgtagtcttaaataacacacaatattcacttttttcaataggtggctaatttgttcttgcaattttggatatcaattaaagtgttgccacagaaaaaaatatatttttactcgtgtttacaaaaacaaaaatattgcccaaatttcaagtcaaacgctctatttcagcttgtaatagttgaaaatagagcgtttgatttatattttgacgttatccattcaaatgaactacttcagaaaaattgttaattgagtaattaattgggtagagataaaatagcttttgccttctacttaccagctaatttattttatctcaaatatttgtttgttctctttataacctttcaccattacttttaatcacctgtttgtaccaatcaaaagattgctttttcattctttttagacttccctttccttgattatctttatccacatagatcatgccatatcttttttccatttctcctgtgccagcagaaactaagtcgataatcccccaaggcgtatagccaattagatttgccccatctaaatagatagcatctctcatattctcaatatgttttttcaaataactaattcgatacacatcattaattgtagaaccagttattttatcaactgcacctaacccattttcgacaataaaaaggggcatttcatacctttcattaagccagttaattgcatatcttaatccaagaggatcaatatgccagccccaatccgacttttctaaataaggattttgcacaagatcttttgattcattgtaatcaaagtacggttcttttccactccccttcactgtaaatgacatataataactaagcccaatataatcgacaattccatcacctataatcttttcatcctcttttgttctatctatagaatagccttttcgctcaatataggtgttgatatagcttgggtaagatcctctacattgaacatctgcgaaccaataacggcgctgcatagcagtgttggcggccaaaatatctttaggattacacgaataaggatagattggtgccatcgcaatcatacacccgatttgaaatttcgagttaattttgtgtccgatattgactgcaagagcacttgccacaagctcatagtgagccgcttgatacatgactttctcccgatcctcatccgctgtataaactaaccccgaatttgtaaatggtgggaaatcctcatcaaaattcgcttgattattaatttcattaaaggtcatccaatacgtcactttatctttgtatcgttcaaaacacgtagttgcaaatcgaacaaaaaaatcaattaattttctattcctccagcctccatatttttccactaaataatatggcatttcaaaatgcgataaggtaataattggctcaatattgtattttaaacattcgtcaaacaagtcatcataatagtttaagcctgcttcattcggtttttcttcatctccatttggataaattcttgtccatgcgatagaggtacgaaagcattttaaacctagttccgcaagaagtttaatatcttctttgtaatgatgataaaaatcaattgcttcatgattcggataattttcgccttctattacgccctttgtaatgcgcctaggcaaggtaactgatccagaagtcatgacatctgcaatacttatccctttaccatcctctttccatgctccttctaattgatgtgccgctaccgcaccgccccaaagaaatgtttcgctaaaaattgccatcttattcacctaaaacctctctcttttacaaaattcagtgttcgcatgtatataaaatttcaaatattcgatctcttaattccggctctaatttattgataatcgctagctcagctaacagattagtcgcttcttttaattcacacaatatatcatttttagagtcatagtccatttctgctagtctaagacattcaacaatgcgggctattttatcgtttgcctgaatttcttctgctttaattttgacagactgagaagtattcgataaaaacaatgggtcaatagccaatctatgaataattatctgatgtactctcgatgctggcacgatttctttatctcctgttacggcgatagtgactgtttttgttgcccagctaaaggagatgctggtaatacaccttttatctccttcgtcctcgattagctcaaactcatttgaatctcctgggaatatatgccaatctatctgcttgggtaattctgtacctgttagtgctggggttggatcaaggggaatgatacttccagcttttgcaaaaacaggcattgtgtctaacggtctaaaaattcctatttttgtatcgcctgaatattgaacatccgtaaaaaaatcaaaccattccccttctggaaaccaaacctctactttggctgtcttatatttatgatttgttttggacgtaatcggcataaccattaactctgtcccaaaaaagtattggttgggaacatgatagctttcttctttcattggataatgataatacattggtgtaatcaacggatagctttcttcatgagttttaacattcattgtatacagatatggcaacatttgatgacgtaacgttaaaaattttttcatgatttgacatacagtctttgagaaagaccatggttccttattattaaaaatgctaggcgagctgtgtaggcgattaattggactgaatacaccaaactgaatccaacgtgtagctaattcttcatcatgatacccttgtctatgcccccctatatcatgactccaccatgtataaccaatattggaagccgtgctagtaaaataaggttgaaaagccaatgatttccatgaaattactgtatctcctgagaaacccactggaaatctatgacttcctggtccagcaaaacgtgacagaataatgttatttttcccagacctgtttatatctttataatgataatgatttagtagccaaagagaatcaaagtcagtcatctcaccctcaatatcctgctgccaatcaatccaccaaaaatcaacaccttgcttttctaatggatgatgtacatcttcaaaataggtttctctaaaggctttatttgacaaatcaaatatggctggttgctctttttcctgatttaaccccagtcgcttacttactgtcggatagcagtcttcaaatgcttggataccgttggctggatgcaggttcagtgttactttcagcttctttttgtgtaacttttctaaaaatgcttcaggatttggaaatagttctttattccaagtatatcctgtccagccacttccaaatctttcaggaacatctgtaatatgccaatccatatcaatcacactcactgacaaaggaacctcttgttcttgaaaggtgtccattaactccaaataagtttcttctgaatacttccaataacgactccaccaatttcccaaagcatatcttggcaataagggtggctgtccagttagatgaaaataagccttcaatgctttaaaatatttccgtccaaaaccgaagtaataaaaatcgaatccttccccttcccgaagtatcgggttatcctcttcatctaacgcaaagctgcttgaatcatctagaatagcaaaaccatttttactaataattccttcagataattctatcgctccatccgttctatccagtgttttaacagttccttttaatgtgttaaatttttcgccaaaataccaacgatttcgatactgggacaaattattcctagattcaataaataaattttttgcagaaaattttccttttttaaaataaacatgaattgcatcagtcagtatctctaatatttcatcattttcaatcacttcaaattttggcggactaaattctctattttgaacgatttttgtccgtctatcctcaaagtggccttcagatgaatattctaatctgattaattcattcgttaaaattgtgattcggtaggtatctccttgaaatacattattcataatgacctcctaaaaaaaatatgatacaatgtgagataatagtaaaaaataggtggtgaacataacatgaaagagtttagacaagcacattcccatggtgattacttgtttccttttgaagtattcaatcaggcttatacgatggccaacatacaaactgtgtatatgcattggcatcaagaaattgaatggattttctgtgaagaaggttctatttctgtctttgttaacggaaaaaaatacattgtggaaaaaggacagatgcttacaattccagaaaaagccatccattatataattacaaatagtgaatgtcattactacacatgtgtatttcaaaaaaaattactcaaaatggacgtattagatggcattacctatcaatacatttgtccttatattaatgaagagctagaaattgaggcagtaatacctgattcgactcatgttatagaaagcttatttaaaaaaatttatactgtcgaacataacagaggcctaacgtatcaattaaaaataagattgcttttactagagctgttttcttaccttattgaaaatcaacatctaaagaaaaatgacaatttcttaaataccgatgtccaaattcaaaaaatttatgcgtatatcgaacaaaattacaaaaaaaaaattacaaatcaacagttatctgctttggtaaattataatcctgaatatttttcaagatattttaaaaaacagtctggttacagtccaacagatttcattaactactatagaatcgaacgtgcttgtgacctcttattccatacaaaactatcaatacttgaaataggaattgaatgtggctttgaaaactgcagctatttcattaaaaaatttaaaagcattaaaggacaatcaccaaaaaaataccgtaaattaatcttagacaatcaccttttaatgtctaagtggtgatgatgaattttcactatatttgttcccctttttcttgttttagtgctaataagtcggcacgtctaacaaaaggaaaccatatgaaataaggaagaacaatattcgtaacaatacttagtaataaaaccctccaaccaccttgtagaaagtcattaaagccaaatggcaaaccaaatataacagaaaatccatttaattttggtaccaatcctgttgatatcgctaagtatgcgacaatatacattaacggagcgctaaataaaaagggcacaatgaaattaaagttaagcatcaatggtatcccaaaattcaaaggttccccaattccaaatatggctggtccaattccaagttttccaaactctctaaactgttttgattttgagcgtaataaatgaaggcaaagagcaatttgatagccgccaaaataaaagatagaaaaaaatgctaatcctgtaatattgggaagtggattcccagctgcagcagcttgcatattttgtgtatctaatgctaataaaattggcatataaaaaggacttaatacattttgcccatgaattccaaaaaaccataaaacctgtgctaagaaagcaaagagcattaaagaaaataaatttcctcctactgactgtaacggtgcttgaatagctgtatagattagttgatgcagacttccagcttgagtaaacgtacaaatataagaaatactactaaaaataatcgctgatattacaaagggaataatacttgcaaaagtattagacaccgcagaagggacgctttctggcatcttaattgtcaaatttttaagcttacatgttttgtaaatatatgccgaagaaatcgcaactagtattgcagtaaatgctccttgagaacctaaccatgttaaaggaatcgctgttacttcacttttttggatgatgtctgaaggcgttaaaatcaaaaatcccactagagaaattacacctgctgtcgctccatcatcattttttaaataacggctagcaatatttttaccaataaaaaaagccatatagatagaaagcagccctaccgtataattaaaggcacttaaaaagatcgttgttaacccaacttcttcaaaaaacttagaaaccgagcctagaggaataaccgctaaaattaacgaaaaagaaccaataatcgtaatcggtaaggtagacatcatcccactagataagccttgcaataaattgttattgctaattttcccagcaaaatcggaaaaacgatcaaacatactggtaacttctttttttatcttttccataaaaaatcccatccttctcataatataattttaccctcgtgcacttaattcaaatcagatatctattattaatgtaaacctttttatttatttattctttactatttttgacagaataatataactattttgacattcatagacaattttcttatttcaagtttatataacatgagtagatagtaagcgtcctataggacgcttacggtcaatcacaagagtcacaggttacttcaaaaaaaaagacaacttgactccataacaagtagaactgataacactagcaagaaaaaaagcagtttgtaatagagaacgatattttaaatgcaagcagcgctgaaattcggatgaaaaaataagtaatcaatgccactaaacataaatactccatacatcaatatgtagaaattttagaagactatcactaaacctattactatcaattacgtccaattgaaaatgaagatgagttagaagcgatcataaaagagtaatttatccataatcaaaatacctacggtatccgaaaactgaaagaatgttagccaatcttagctataattatttgacgaaaaatcggttggaccatgaaacaacaaggattgaaatctatctatactatcgctcattttaaagtttaccgaaaaactgataacgaaagagagaaagcgaatatattggattgagcctttacactagagaatcacttagtgtttttttcagctgaaaatgtctccacaaaatcagttgaaaaataccccacttcatttatcttaaccactgctttgtatcttctactcgaaaagaagaaccacttagatcaagtacgtgcgcccgatgggcgattcgatcgacaattgcagcaataagcatggggactttgaatgtttcttcccatcgttcaaactccaagttggatgtaatgatcatggaaccattggtatttctattagaaagcagattaaagaggatttcactacctacctgatcaaatgacacatagccaagttcgtctaatataaccaagtcatatttactaaaacggcgcttatagtaagtcagctggtttgcactcattgcttcttttagttcaatcacgagattaggaatgcttataaataagacactttttcctgctagacaagcctccattcctaatgtattggctaagtaagttttcccgacacctggatttccaatcaatattaaaatctctttttgctcgataaatcgaagttccttcagttctgtaatcttttttcgaagttttggatccaggtgtgcagttagatagtgatcaaaagttactcggttgggcagttttgatccagtaatcagtcgttggatccggttgcttttgcgattctcaaactcagcttgtaacagcatttctagaaatcccacataagattcagaaagatccaatgcttcttggatcgcttgtgtataattttttcgaatatgggacaatttcaaatgttttgttagtgtatcaatactcataacgactctctccctagataaagtttcgtataggcctgtacttgaattcttgcggcatttacagcttttgttttcggccgctcgcttagtctttcttgacgttcttcaagtgcatcggactctagatgctgcaccagttcttccaacgggactgcctggtagaaggttaaacgttcgataaatcgcttgggatcattttgatgatattggagaaaacaacgatgtaatctcggaatcccctgaagagccagtgaatgtttgagagccttcggcttacgagaaaatgtatgcaagtaatgttggatttgaatggcataattcttactttctttttcaagtagatgccgacaaagggagcgtcaataattttgtgtaaatggttcttccctactgtagattgtttctaattctccatcggttgactcagcatttgttcgagctcgccttcggcctgttggaaacctttatgactgcgacctaggaatttttggttgtgagtatcaaaagacgagactaagaaacgttccatcgactcttcattttggaactgttccttgcggtggctgtatttcttgatttgcttattaaagaattcaatcaagttcgtagagtaaatagtcttgcgtatggctaatgagaaaccatagaaagtgagcaggtaatcgttcgaaaggatcgattccactatttttggatagctggttttccatttttccgcaaaagcaccacgttcttccaatgccgcctttttagatgaggcttgatacaccattttaaaatcatcacagacttccttacgatcatcgacacgcactttgtgactgatattacgggaaacgtgcacacagcaatgttgaaaacgggctttggggtagaaccgctgcacggcccctgccatcccctttaagccatccgtgatgaaaaggaggacgtttttcacgccacgttcctggaggtctattaaaatctcttcccaaatcgtgatagattcagttggtgcaatcgcatagctcaacacttcctttgaaccgtccgggcgaatgccaactgcgatacgaatggcttccttggcgacggttttccgctttaaagggatataggttgcgtccatataaatagcggcataacggtcatgaagctcacgttccttaaatgaagtgacttcttccgtaaatgatttagtcatattggacatggtttggggcgtgtagtgatgcccatacattttctcaatcaagtctgcgatttccgacatggtaataccttttcggaagaggtgaatgacggtctcctctaaggtatcattcgtccgtctataagcaggaacagtctgttgcttgaactcgccgttgcggtcgcgcggaatctgaagatgaagttccccgtactcggtcttgactgtacggtcataggagccgttacgagaattacccgtgttaaaaccaatgcgatcgtacttttcgtaatcgaggaaagccgttaactccgttttgagaagcgtattgacagctttttccaaatggacacggaataattcattcaaatcgcctttgttcgctagagtctttagaatttctgtagtaaaatcgttcatatggaagtcctcttttctgtgaatgtgttgtggtaactctattctacacaagggacttccttttttctatttacacaaaatattttacactctcaaaataaaataagggagtaactttctctaaccaaaagttactcccttattttattttgttatcactgttgaatcatcatttataagtgaacgtaaaagataatagatacccaaaaacagaaagaaaaataacggtaatacacggagtaaaacaaacggagtttcaaaaatgaacgctttccaaaaccacataccctccatttcccataaaccttgggtaaaataccatgatttaaagggttctgttgcaaagttttccaaaaaatctattttagtgtaaaattgagaaaaaagacagagaggacagagtaatgaatcattttaaaggcaaacaattcaaaaaagacgtcattattgtcgctgttggttactacctgcgttacaatctaagctatcgtgaagttcaggaattgttatatgatcgtggaataaatgtttgtcatactacgatttatcgttgggtgcaagagtacagcaaagtcctctattatctttggaagaagaaaaatagacaatccttctattcatggaaaatggacgaaacctatatcaaaattaagggacgttggcattatctttatcgtgcaattgatgcggacggcttaaccttagatatctggttacgaaagaaacgggatacgcaagcagcctatgctttcttaaaacgactccataaacagtttggtgagccgaaagcaattgtgaccgataaagcaccttctcttggctccgcctttagaaagttacagagtgtgggtttatatactaagacagagcaccgaactgtgaagtatcttaacaatttaatagaacaagaccatcgacctattaaacgacgaaataaattttatcaaagtctccgtacagcctcttccacgattaagggcatggagaccattcgaggaatatataaaaagaaccgaagaaatggaacgctcttcggcttttcggtgtctactgaaatcaaggtattaatgggaataacagcctaagatatttggagttcagagagggcgcgtttgattttcaaacttcgcaacagaaccaattcaagttacgggcatacttccaacggtttcccttaaaagccagaaaacgtgtgacacacatcgtgatggatatgaatgcctcttacgatgcagtgacgaaagaagtctttccaaatgcgcgactctctatcgatcgcttccacatcatccaacaaatgacgcgtgcatttaatacccaacgaattcagacaatgaagcagctaaagaaaagtgatccacaagcgcaaaaaaattaccgaaagctgaaaaaatattggcgaacaatcctaaagaaaaatacaaaactaaactacacctcttttaagcaatttcccctcttccaagggaaatacatgacggagtcggaggtgcttgattacctactctctatagataaccaactacgacaaagctatgaagtctatcaagagttattagctgcttttgatgcaaaagattttactgaatttttcaatctcattgaatcattgccacattccttgaatgatgggtttaaaaaggcaatttgttatctgaaaaagcacacagaagcaatcacaaactccttaaaatatccctattcaaacggaaaattggagggaaagaataacctcatcaaagtaatcaaaagaattgcttttggatttcggacttttcgtcatctccggatgcgtgtcctgattcaacagaacatctgtgaaatcatttaataacgcaaaaaaggaaatgccgaagcatttcctaacatacgatttgagcaaaacaatagcaattgacaaagaacctaaataatttccataaaaaacgcactcctttccaataattttaggaaaggagtgctttatttcatataaaatcaattttttatacacatgctcattggctatatttcagggttctcgagaaataaagcaagccagtttgacaatcgacataacgttcttttccaaattgctggcggctttttttcctttccaccattagtatactacagtttctgcctttcatccttcagggtgaatgagcttgcgaattcatgtatgtttgacaaagaacctctttttctaaaaatagaccgacaaagtactgcctagaatcaacccattttttaaaataacgtacgatttttatttagtggcacgttatgagagtctctcgttcgtttttctgatctttttattgactcaactgcctataaaacgacggaaaaagtatttcatgaataattcaggtacttataatcagtacaataacctgataaaacccctagtttaactagggaatccgaagctaagccctcttttccaaacccagagagaagaattaaccctgcgaaagcaattaatttcattagttcttctgaatgattcaattgacttcacttactcagtatattaattggattcatctcaatcattttattaaaagttggttcactcattacttttaatagttcttctttcaaacttgttaaaatataggtaagcccaggcgttcctccataagttggcaaatatttttttcgtcccatatcacctgaaagacaaatctgattttcataacccgcatcaaccagtcgtttaattaattggacgcggtctgcatcatgattcgccaactctcggccaatatgatctatacaaatacttgctcccgtttcacagatttgagctaaatagtgaaaatctttagttaaatctacatgactcaaacaaatattacttgctttcgcaccgttttttgttaaacaattaatttgctccagtcccatcgtccccccatcacaatgcgtaataatgggaatccctgtttttttttgtacttgaccggctatggctagtattcgttgttcagccaatgtaacctcatttttactcgtacctactttcattgctcctggcaaaaggttttgtgaagtgactccgtgagttatttcggaataaagcaactcaaagatctcatcatcattgagcgttgtcaaccattttggctgaaactcttccttatggaatcccgtaacaaatgctacattcactccggtagcttcagatatcattttcaaagctaacggatttcgtccataattaattggtgtcaaatcaacgatagtttttccaccagcttgtttaaaagccataacttccgcaatactatgataaatatcatccaaggtataatcttcatactttcttaactcattaggaatgacatataaatgttcatgaataaatgttgtacccaaagactcagcttcgattgggcctgtaaccgtattgatcatgcactcatctcctaccattcagcgattgtaccatcataatttttccacttaggattggtccaaactaaaccttcttgtgcaatttctttcactcgatcttcgtccatttctaaccctaaacctggttttgtcggaagatctacgaagccatctttgtattggaatatctctttattctttacaaaatctaacaaatcaaaccctttgttgtaatgaatacctaagctttgttcttgaataaacacattaggtgtacaagaatcaacttgtaatgtagctgctaacgcaatcggtccatatggtgcatggggggcaactgctatatcataagcttcagccattgcagcaatttttcttgtttctaaaatccctccacataaagctacatctggttgaatgatatcaatcgctccctgttgaagaattgatttaaattgccatcttgtatacaaacgttcacccgttgctagtggtacagcaactgcattggctacttcactgaaatgttcttcattctccggcaaaaccacttcttctaagaacattggatgatagggttccagtgcttttgctaaaaccttagccattggtttgtgaacacgaccatgaaaatcgacaccaatgctcaatgtatctccaaaacgttctctaattgaagcaacacgttccactacttcagctactttttcataagaatcaatgtagtgtaattcttctgtcgcgttcattttcacggcggtaaacccacgatctactcgatcttgtgcctgctctactacttcagaaggacgatctccaccaatccaagaatatactttgattttatcacgggctgctccacctagtaattcataaactggaacatttaaggctttccctttaatatcccataaagccatttcaagtccagagacaatcgttccattaataggaccacctcggaaaaatgaacgatgcatttcctgaaacagacgttcaattgcaaatgggttttgaccaactaagaatcgatttcctatctcataagctcctgccacaactgtttcagtcttagttccagaaatcatttcaccccagccttcaataccttcatctgtagatattttgacaaaaatccatcttggttttactttatagactgtaatttttgaaattttcactgtatgccctcctgaatattagaaaatatttgaaataaactcagcaatcttcattaaaatgaaaccaataatgtgtgtacctgcatcttcggtagatatttgtgtcattcctgctggtaattggaatcccccagccaaagctaattgtgtatgtatgccggctaaactagtagcaattaaaagcacacaagctgttataatcgtggtggaaagtattccgcgaataatatttccttttgaaaaggcgaccggccatgcagatagccacattgcttggtaggcaatatctgaaataggtaagagtttgttacctggtaaaatagcagccaacactaaggtaatcggaaccatgataatacccgtagcaatggcacttgaattagcaactgtcaacgcagcatccacacccattgtaaaattgtttcctggaaattttacattcaagaatttcttaacagaattagcaaagggtaataatccttccattaaaatttgcatcattttaggtgttagaaccattgttgcagaagtactcattcccactatcaataccttatcaacaggttcttttgctaataacccaataaccaagccgatgacaaatcccataaacataggctcaccaacaaaaccaaaccgctcttgaattttttcaggacgagcatctaccttatttaatccaggaatgcggtcccacaatttgttaagtagccaagccaagggtgcccaaccaactgagttcgcagtcgggaaattaaccccttctagttcaaagtaatcctctactaacggcgttgtccaatcagcgagtttaaaactaataattgcatcaatcgccccgaagattaccgccaatataatatttttatccgttgcataataaaccaaagcagctacaaaaatatagtgattataactccagaaatcgaccattactgtattggtctttttaaaaatcagcatcaacacattaatacccaaaataataaataccataactgctgctagaggaaaagaccaagtggctgctgcacgagctggccagccgacatccataatacttgtttgaataccccaatttttgaccattaactgaacagatggacctacctgtgaaataaaccaattaataataatatttacacccgcaaaaccaatccccacagtcaacgctgattttagtaatgtatttagcttaattctaaaaaataatcctaaaatcaagataatgataggcatcataatcatcggacccaaacttgagatccagtttaacgcatcaatgacaatattcatttttcaccctcctagtcaagctctttcaatgcttctaacaccaaagattcagatttttcttcattcactccagtaacaaatggtgttccaggtataactttaattcctttggttacattttcttgtaatttccctgtaggaacgataaagtcaacttgatttgattctaaagcacctgcaacttctgaaaattttagttgcaaaattcgaggttctggtaatccatttgtttttgctattttccgaattttattagctgccattgtagatgtaatcattgatgatgcacatgcgacgataattgtttttttactcattgtatttccctccaatttattgattaaatgcagttaaaacttctgttttactctttgcttccataattgcttgtaagaaatcctgattggtaactttactcatcaactccttcaataattgcggttgcttatcgggactatcgaataaaaggtgaataataacattcactgaaaccatttcttcgggatcatccattcgctgaaaatgcaaactatctttaagaacggatactaaaatagcggtaacatttgataactgataatctgtatgtggaattgcgattgagcgttccccaatatatagccccgttggataagttgtttctctcttagtgattgactcgagatatccctcctttaccatgttttccgtcatcagtttctttgtaatcttttgaaagtattcttcttggtttgaaaaactttgatttaacaaaatatttttttcttctaatttaatgagactcatcttcttcacttcctgcttcagctagtttatctaaatatgattgaattgattttcgaatagcttgcccattgcggttttgtatatcagctttttgaaacatgcttgatcctaccccaaagtacacaactcctgcttttttaaaagccgcaatattatcaatcgtcactcctccaactgccattaaaggccgtataccaaaaggaccggccagttgtttaaagtaggttggccctacagtgactgctggaaaaacctttacaatatcggcaccttcatcaaacataacttgaatttccgatggcgtaaaagctgatggcacagttaccaccccacgttctttagccaacgaaaaaattggtgttgaaaatttttttggtcctaataaaaatttcgcaccaccagcaattgcttgatctgcttgtgaaaatgttaaaactgtccctgcaccaatcaataattgttgcccaaattttttgttgccttctgtgatgatacgtgcaaagtcatcattattggttgttacttcaattcctaccgaagtgttcatcgcagccaattcttccatgacaaacatcgcctcttcaaaactatatcctcttaaaatgatggttaattcaggaaaattcgttattgacatattgcttcctccttaaaaaattttttattttttttctcacttcatcttccgtcgtgcaaagaagtatttcttgctgatattcctcgtccttagaaagttgtagtaattggttaatcgcaagtaaataattttccttctttccaattgcaaaaggggaaataaaatggataggcctatttccaggaaaaataattggatcaactgatataagtaacgagcaaccgcccttaattaccccattttctggcgatgaatgtggaatagcaatacgattattaagaaaataataagcctcttcatccgccatttgactcattaaaatagtctgatagttctgattaattacctgctcctttaataaaggctgacaagacaattccatcgcgttctgccaagtaagttgtttcgtagatacaagaataatcccttcagaaacaagcaattccacaaaagatatcttttgtgcctgtttactttgacgatctagatatattagtgaatttgcataattaattaaaaatctctcaatatcagtttgtagactttcttcattttgaacagcagagtaacgcttaataatttcagtaaggttcctagtctctttgctgatattattcgtagaaaaatcaatgagtacacggttccgcaagcggtttttttcttcttcgttcataatcggttgtataatatataatggaatttcacttttcaatggttgattgctaaaaatcaaatcaacatcttcgacaaacttatccatctctctgaccgaagaactagcaacaaactgaatatctggaaaaatttctttcaatgttttcgccattacattggccataatcaatccattgctacatacgacgattgccttttttctaacaggtgtttcgataatagaagaatttaatagctccgaacaaaaataaacagaaatcaaatataattcagtttcaggaatcgtcttacgcaaaaatgcttccaaaggtacaatggattctttaacaaaattaagtaccgcactaacttcatggttttccttaacaatttcagctaaatcatctatttcaaatggtaattcgtagcgaattcgatagattgcaggtcgtaaatgattcatcaatcgattggtcaactcttctttattactaatccgaatagctgatttactttgaaataaggtaatcatctccataattacttgatagattcttgaatctaaaatttcaaactcatttgaaattgtattgaatgataaaaacagaagcgtcaaccattcataatctatagctatctcagcatgttgataatgttgatcaatgcagcttcgaatcatttgaaactcatctaattcctgtaaatcataactaaaatcaatctgtcctttcgtccttcttttaaaactagaaagtgataaacctatcaaataataaagtttggttagtgaattatcagaaaatttcaatttaaaagtttgttcgtaggtgtgaataaaaaaaccaacaaattccctttcttcagaaaagagtgactcaaaacggttaactgttgcatgcctttcaaataaataattgaaaacttctaagagcaatgtatgaagctttgccatgcttgattcaatcatatagccattttggggatcaaatatcaaagtgtagtctggtggcaactctttttttattttagaaaagtcgtttctagccgtatttttactgataccaataaacgccattatttcttgggttgtcacttttttggggttggctagaataaataacagttccgaatatcttcttatctcactataagccaaatcatcgtttatatattcaggaatcgcaccttctttaaaaaccattgcttgattcatgtatatcaaaagtttttgaagatcattggcttcatataaccactcccctgagttacttcgctttatcagactcaatccatgaagggataattcatcattaattttttttatagagtaagttatctgcctagtcgaaaaatgtactaatgatttcaattgttgagagtttgtcacatgtgatcgtacaatggtttctaacagttttaaatcttttgtattcacattcatctacctccctgagttaaatataaccgcttacagtattaattggaatatccaaaatttgtcaaaccttggcttaaatcagacaaatgacaggcacttctttaattttttatcttatgcaccatcagaatggtgtggagtaccactcaattttggaggcttttcatgtataaattacaaacaaccgttcaattggcttttgaagatttcaatcaaccgataggtctcaaaatgaatccgtctaaccgttggattcaaaaagcagagctcattccatgggctgaacttgaaaaagactacgctaaaaattttcgtaaaaaaaaaggaaacgtcgcaaaaccctttcgcatgaccttcggagctctactgattcaaaaggaatatagctatagcgacgaagaaacggtcttacaaattcaagaaaacccgtatttatagttcttcatcggtttgccgggctatcaagatgccaagcctttcgatgctctacaatggtctatttccggaaacgcttggacgaaacaacgttgatagaaatcaatgaaaaaatactcgtcttcgacaagaaaaaagacgataaggacaacgattcttatgacgatttcaattccggaacattgattttggatgccacttgtgctccacaaaacatcaaatatccaaccgatacagaattaatgaatgatacccgtacccatgccgagaaaatcatcgatgttgtttgtgaagggaaaaaactgaaaaagccggttctataatatttggttttgttactcaaactgagtagtgacgccaaatatttttttataacaaaaagacatctggttgtcctataattaaatcggcaaaaacaatcataggaggataaccaaatgtccataactaagaatatcaaatgtacggatgaaaagacaagtcattccatcaaacaaattttgaacatcaaagattcccatattaccttttcaaaagatgccattagtaaagagcgcgttcatggccgtatggccaatgtatttaccggcttattaactggagaagcgcatcgttgcgaatgttgtgggtttgattctgtcatccgtcatgcttatcatgatagttggattcagttgcttccgtatcaagaagtaccaacttatctacacctgtacaaacggttctgttgcaaagttttaaatctactatcaaataaggtagaataatagaaaaagatagcaggaggaatgacgatgaatcattttaaaggaaagcaatttcagcaggatgtgattattgtagccgtgggcaactatcttcgttataaccttagctatcgtgaagttcaagaaatcttatatgatcgtgacattaacgtttctcatacgacgatttatcgttgggtgcaagaatatggcaaactactctatcaaatttggaaaaagaaaaataaaaaatccttttattcatggaaaatggatgaaacgtacatcaaaattaaaggaaaatggcattatttgtatcgagccatcgatgcagatggtttaaccttggatatttggttacgtaaaaaacgggacacacaagcagcctatgcttttcttaagcggttagtgaagcagtttgatgaaccgaaggttgtagtcacagataaagcccctctattacaagtgcctttaagaaactaaaagaatacggcttttatcaagggacagaacatcgtaccattaaatacctgaataatttgattgaacaagaccatcgtccagtaaagagacgcaataaattctatcgaagtttacgcactgcctctaccacgattaaaggcatggaagccattcgaggattatataagaaaacccgaaaagaagtcactctcttcgggttttcggtctgtactgaaatcaaggtattattgggaatcccagcttaaatcatagataccgtaagggattttattctttatttaaaactttgcaacagaaccttatttttcccgtaaaggtaagttgctccaaatgagacgacacaacttgctagcatacaaataaagaatattggccagaattcaaacggaatagacaagaaaccaggaattccactgataccaacagaagttgcaatgacgtgttgtgacgccataaatcctccaattattccagaggtcagaatggaaaccacgaatgggaatttatactttagattaaccccgaacattgctggctcagtgatacccatataagcagacaaaccggcagccagtccaacacctttcaactttttattttggattaagaaattcattgcaatagcagcagaaccttgtgccaaacttgacatgactccaataggccaaatataatctccaccgttcgccatcaattgaatatgaactggtaaaaacgcatgatgcatccctgtcacgactaatggcgcaagaccaataccataagcaaatccgccaataaatggaactttttggaataaccatacaatacctgcgacaatcgtattaccaatagcaattgtaatcggcgctataataataaatgttataacactagtaaaaagaattgcaactggtgcaacaaccaacagttggattgtttcaggcacacgctttttcaagaatagctctgttttagctaacacatagccggaaactagagctggcaatacttgtgcttgtagtcccatcttagagatggacaatccaaagattgtccaatgtggaatatctcccgtggttactgcttgcccgtaattccaggcattcatcaaatctgggtgtacaaagactagacctaacacaatcccaagaagaggatttcctttaaagtattttacagttgaccatgttattaacgcaggcagaaattgaaaggaagtgtttgcgataagatttatcatatcagcgacatcagcaatattaggatatacttcaatgagtgactgctcaaaaaagattcctgggtttgttaataaattattcagtcccatcagtaaaccagctgtaacgatcgctggtaaaatcggcacaaatacatcacccaatattttaactgcacgttgaaaccaattcaaattcaactcagccgctacttttttaacgtcttctttgtttgccccactcagcccagattggcttataacctcttcatagatatctgctactttaggaccgataacaacttgaaactgtccattagcattgaaggtacccttcacatcttccaggttttccaatcctgccttatcaactttagtgtcatctcgcaaggcaaacctcagacgtgtcacacagtgagtcagtgctgcaatattctcttttccaccaacaaagttaatgattgatttagcttcttctttattactcattaattcttacctctatttcttctttattagttaatgcttgagatgaatcattgcctaccatgatccaa
